United States Patent
Balakrishnan et al.

(10) Patent No.: US 11,168,130 B2
(45) Date of Patent: Nov. 9, 2021

(54) ANTIBODIES THAT TARGET HIV GP120 AND METHODS OF USE

(71) Applicant: Gilead Sciences, Inc., Foster City, CA (US)

(72) Inventors: Mini Balakrishnan, Foster City, CA (US); Brian A. Carr, Foster City, CA (US); Craig S. Pace, Belmont, CA (US); Doug Rehder, Bonsall, CA (US); Matthew Robert Schenauer, Dana Point, CA (US); Loredana Serafini, Orinda, CA (US); Heather Theresa Stephenson, San Jose, CA (US); Nathan D. Thomsen, Castro Valley, CA (US); Helen Yu, Mountain View, CA (US); Xue Zhang, San Diego, CA (US)

(73) Assignee: GILEAD SCIENCES, INC., Foster City, CA (US)

( * ) Notice: Subject to any disclaimer, the term of this patent is extended or adjusted under 35 U.S.C. 154(b) by 0 days.

(21) Appl. No.: 16/460,094

(22) Filed: Jul. 2, 2019

(65) Prior Publication Data
US 2020/0223907 A1    Jul. 16, 2020

Related U.S. Application Data

(60) Provisional application No. 62/810,191, filed on Feb. 25, 2019, provisional application No. 62/693,642, filed on Jul. 3, 2018.

(51) Int. Cl.
*A61K 39/42* (2006.01)
*C07K 16/10* (2006.01)
(Continued)

(52) U.S. Cl.
CPC .......... *C07K 16/1063* (2013.01); *A61P 31/18* (2018.01); *A61K 45/06* (2013.01); *C07K 2317/21* (2013.01); *C07K 2317/31* (2013.01); *C07K 2317/41* (2013.01); *C07K 2317/52* (2013.01); *C07K 2317/54* (2013.01);
(Continued)

(58) Field of Classification Search
None
See application file for complete search history.

(56) References Cited

U.S. PATENT DOCUMENTS 7,317,091 B2    1/2008    Lazar et al.
7,662,925 B2    2/2010    Lazar et al.
(Continued)

FOREIGN PATENT DOCUMENTS

WO    WO 2012/158948 A1    11/2012
WO    WO-2012158948 A1 *    11/2012    .............. A61P 31/18
(Continued)

OTHER PUBLICATIONS

4JPV Structure Website, https://www.rcsb.org/structure/4JPV, Retrieved from RCSB PDB (Protein Data Bank) on Sep. 30, 2020.
(Continued)

*Primary Examiner* — M Franco G Salvoza

(57) ABSTRACT

Antibodies that bind to HIV gp120 and neutralize HIV are disclosed. Also disclosed are methods of using such antibodies alone or in combination with other therapeutic agents to treat or prevent HIV infection.

44 Claims, 8 Drawing Sheets

Specification includes a Sequence Listing.

(51) Int. Cl.
*A61P 31/18* (2006.01)
*A61K 45/06* (2006.01)

(52) U.S. Cl.
CPC .... *C07K 2317/55* (2013.01); *C07K 2317/565* (2013.01); *C07K 2317/567* (2013.01); *C07K 2317/622* (2013.01); *C07K 2317/732* (2013.01); *C07K 2317/76* (2013.01)

(56) References Cited

U.S. PATENT DOCUMENTS

| | | | |
|---|---|---|---|
| 8,039,592 | B2 | 10/2011 | Lazar et al. |
| 8,088,376 | B2 | 1/2012 | Chamberlain et al. |
| 8,093,357 | B2 | 1/2012 | Lazar et al. |
| 8,093,359 | B2 | 1/2012 | Lazar et al. |
| 8,383,109 | B2 | 2/2013 | Lazar et al. |
| 8,388,955 | B2 | 3/2013 | Lazar et al. |
| 8,394,925 | B2 | 3/2013 | Chamberlain et al. |
| 8,546,543 | B2 | 10/2013 | Lazar |
| 8,735,545 | B2 | 5/2014 | Lazar et al. |
| 8,858,937 | B2 | 10/2014 | Lazar et al. |
| 8,937,158 | B2 | 1/2015 | Lazar et al. |
| 9,040,041 | B2 | 5/2015 | Desjarlais et al. |
| 9,353,187 | B2 | 5/2016 | Lazar et al. |
| 9,493,549 | B2 | 11/2016 | Diskin |
| 9,783,594 | B2 | 10/2017 | Scheid |
| 9,803,023 | B2 | 10/2017 | Chamberlain et al. |
| 9,879,068 | B2 | 1/2018 | Diskin |
| 9,890,207 | B2 | 2/2018 | Diskin |
| 10,184,000 | B2 | 1/2019 | Lazar et al. |
| 10,336,818 | B2 | 7/2019 | Chamberlain et al. |
| 10,584,176 | B2 | 3/2020 | Lazar et al. |

FOREIGN PATENT DOCUMENTS

| | | |
|---|---|---|
| WO | WO 2013/016468 A2 | 1/2013 |
| WO | WO 2013/090644 A2 | 6/2013 |
| WO | WO-2013/192589 A1 | 12/2013 |
| WO | WO-2016/196740 A1 | 12/2016 |

OTHER PUBLICATIONS

4LSV Structure Website, https://www.rcsb.org/structure/4LSV, Retrieved from RCSB PDB (Protein Data Bank) on Sep. 30, 2020.
5V8L Structure Website, https://www.rcsb.org/structure/5V8L, Retrieved from RCSB PDB (Protein Data Bank) on Sep. 30, 2020.
5V8M Structure Website, https://www.rcsb.org/structure/5V8M, Retrieved from RCSB PDB (Protein Data Bank) on Sep. 30, 2020.
Klein F et al. (2013), "Somatic mutations of the immunoglobulin framework are generally required for broad and potent HIV-1 neutralization", Cell, 153(1): 126-138.
Lee J H et al. (2017), "A Broadly Neutralizing Antibody Targets the Dynamic HIV Envelope Trimer Apex via a Long, Rigidified, and Anionic β-Hairpin Structure", Immunity 46, 690-702.
Scheid J F et al. (2011), "Sequence and Structural Convergence of Broad and Potent HIV Antibodies That Mimic CD4 Binding", Science, NIH Author Manuscript, vol. 333, No. 6049, pp. 1633-1637.
Scheid J F et al. (2011), "Sequence and Structural Convergence of Broad and Potent HIV Antibodies That Mimic CD4 Binding: supporting online material", Science, NIH Author Manuscript, vol. 333, No. 6049, pp. 1-54.
Zhou T et al. (2013), "Multi-donor Analysis Reveals Structural Elements, Genetic Determinants, and Maturation Pathway for Effective HIV-1 Neutralization by VRCO1-class Antibodies", Immunity, 39(2): 245-258.
Intl. Search Report-Written Opinion dated Dec. 10, 2019 for Intl. Appl. No. PCT/US2019/040342.
Office Action dated Mar. 7, 2021 for GCC Pat. Appl. No. GC 2019-37876.
Examination Report dated Jun. 11, 2021 for Australian Pat. Appl. No. 2019297324.
Intl. Preliminary Report on Patentability and Written Opinion dated Jan. 14, 2021 for Intl. Appl. No. PCT/US2019/040342.
Office Action and Search Report dated Dec. 7, 2020 for Taiwanese Appl. No. 108123418.

* cited by examiner

ANTIBODIES THAT TARGET HIV GP120 AND METHODS OF USE

CROSS REFERENCE TO RELATED APPLICATIONS

This application claims the benefit under 35 U.S.C. § 119(e) of U.S. provisional application No. 62/693,642, filed on Jul. 3, 2018 and U.S. provisional application No. 62/810,191, filed on Feb. 25, 2019, which are hereby incorporated herein by reference in their entireties for all purposes.

SEQUENCE LISTING

The instant application contains a Sequence Listing which has been submitted electronically in ASCII format and is hereby incorporated by reference in its entirety. Said ASCII copy, created on Jun. 10, 2019, is named 1232_P2C_SL.txt and is 899,216 bytes in size.

FIELD

This disclosure relates to antibodies and antigen-binding fragments thereof for the treatment and/or prevention of human immunodeficiency virus (HIV) infection.

BACKGROUND

Human immunodeficiency virus (HIV) infection and related diseases are a major public health problem worldwide. Most currently approved therapies for HIV infection target the viral reverse transcriptase, protease enzymes, and integrase. Yet resistance of HIV to these existing drugs, long-term toxicity, and lack of patient adherence to daily dosing regimens have been associated with these therapies. Therefore, it is important to discover and develop new anti-HIV antibodies with advantageous properties suitable for therapeutic uses.

WO 2012/158948 describes human anti-HIV antibodies derived from memory B cells of HIV-infected donors, which are capable of inhibiting infection by HIV-1 species from a plurality of clades. Anti-HIV antibodies are also disclosed e.g., in WO 2005/058963, WO 2013/090644, WO 2014/063059 and EP 0690132B1. The therapeutic use of the antibodies may be limited due to their intra-patient viral coverage, pharmacokinetics, polyspecificity, and other properties. Accordingly, there is a need for novel anti-HIV antibodies for therapeutic uses.

SUMMARY

The present disclosure provides compositions for treating or preventing HIV. More specifically, provided herein are antibodies that bind human immunodeficiency virus (HIV) envelope (Env) glycoprotein gp120 (gp120). This disclosure provides anti-HIV antibodies and antigen-binding fragments thereof, including broadly neutralizing anti-HIV antibodies and antigen-binding fragments thereof, pharmaceutical compositions containing such antibodies and fragments thereof, and methods for using these antibodies and fragments thereof in the treatment and prevention of HIV infection.

In one aspect, this disclosure provides an antibody or an antigen-binding fragment thereof that binds to human immunodeficiency virus-1 (HIV-1) Envelope glycoprotein gp120. The antibody or antigen-binding fragment thereof comprises a heavy chain variable region (VH) comprising VH complementary determining regions (CDRs) and a light chain variable region (VL) comprising VL CDRs. In some embodiments, the VH CDRs and VL CDRs have the sequences set forth in: SEQ ID NOs.: 137, 138, 139, 140, 141, and 142, respectively; SEQ ID NOs.: 159, 138, 139, 140, 141, and 142, respectively; SEQ ID NOs.: 137, 160, 139, 140, 141, and 142, respectively; SEQ ID NOs.: 137, 161, 139, 140, 141, and 142, respectively; SEQ ID NOs.: 137, 162, 139, 140, 141, and 142, respectively; SEQ ID NOs.: 137, 163, 139, 140, 141, and 142, respectively; SEQ ID NOs.: 137, 138, 164, 140, 141, and 142, respectively; SEQ ID NOs.: 159, 138, 164, 140, 141, and 142, respectively; SEQ ID NOs.: 137, 138, 139, 140, 165, and 142, respectively; SEQ ID NOs.: 137, 138, 139, 140, 166, and 142, respectively; SEQ ID NOs.: 137, 138, 139, 140, 167, and 142, respectively; SEQ ID NOs.: 137, 138, 139, 140, 168, and 142, respectively; SEQ ID NOs.: 137, 138, 154, 140, 141, and 142, respectively, or SEQ ID NOs.: 137, 138, 139, 570, 141, and 142, respectively. In some cases, the antibody or antigen-binding fragment thereof comprises in framework region 3 (FR3) of the VH at position corresponding to 74a, 74b, 74c, and 74d (Kabat numbering) the amino acid sequence set forth in SEQ ID NO: 453 or SEQ ID NO: 627. In some, the VH CDRs and VL CDRs have the sequences set forth in: SEQ ID NOs.: 137, 138, 139, 140, 141, and 142, respectively, wherein the antibody or antigen-binding fragment thereof comprises in framework region 3 (FR3) of the VH at position corresponding to 74a, 74b, 74c, and 74d (Kabat numbering) the amino acid sequence set forth in SEQ ID NO: 627. In some cases, the antibody or antigen-binding fragment thereof comprises a FR3 of the VH comprising the following amino acid sequence: RVSLTRHASWDFDTFSFYMDLKALRSDDTAVYFCAR (SEQ ID NO: 628) or RVSLTRHASFDFDTFSFYMDLKALRSDDTAVYFCAR (SEQ ID NO: 629). In certain embodiments, the antibody or antigen-binding fragment thereof comprises a FR3 of the VH comprising the following amino acid sequence: RVSLTRHASFDFDTFSFYMDLKALRSDDTAVYFCAR (SEQ ID NO: 629). In some, the VH CDRs and VL CDRs have the sequences set forth in: SEQ ID NOs.: 137, 138, 139, 140, 141, and 142, respectively, wherein the antibody or antigen-binding fragment thereof comprises a FR3 of the VH comprising the following amino acid sequence: RVSLTRHASFDFDTFSFYMDLKALRSDDTAVYFCAR (SEQ ID NO: 629).

In another aspect, the VH CDRs and VL CDRs have the sequences set forth in: SEQ ID NOs.: 137, 138, 139, 140, 141, and 142, respectively; or SEQ ID NOs.: 153, 138, 139, 140, 141, and 142, respectively. In certain cases, the VH of this antibody has one or more of: histidine at position 3, serine at position 5, glutamine at position 72, tyrosine at position 76, valine at position 82c, isoleucine at position 89 (position numbering according to Kabat). In certain cases, the VL of this antibody has one or more of: arginine at position 14, alanine at position 60, valine at position 83, and isoleucine at position 98 (position numbering according to Kabat). In some cases, the antibody or antigen-binding fragment thereof comprises in framework region 3 (FR3) of the VH at position corresponding to 74a, 74b, 74c, and 74d (Kabat numbering) the amino acid sequence set forth in SEQ ID NO: 453 or SEQ ID NO: 627. In some cases, the antibody or antigen-binding fragment thereof comprises a FR3 of the VH comprising the following amino acid sequence: RVSLTRHASWDFDTFSFYMDLKALRSDDTAVYFCAR (SEQ ID NO: 628) or RVSLTRHASFDFDTFSFYMDLKALRSDDTAVYFCAR (SEQ ID NO: 629). In certain embodiments, the antibody or antigen-binding fragment thereof comprises a FR3 of the VH comprising the following amino acid sequence: RVSLTRHASFDFDTFSFYMDLKALRSDDTAVYFCAR (SEQ ID NO: 629). In certain embodiments, the antibody or antigen-binding fragment thereof comprises VH CDRs and VL CDRs having the sequences set forth in: SEQ ID NOs.: 137, 138, 139, 140, 141, and 142, respectively, and comprises in framework region 3 (FR3) of the VH at position corresponding to 74a, 74b, 74c, and 74d (Kabat numbering) the amino acid sequence set forth in SEQ ID NO: 627. In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a FR3 of the VH comprising the following amino acid sequence: RVSLTRHASFDFDTFSFYMDLKALRSDDTAVYFCAR (SEQ ID NO: 629). In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a FR3 of the VH comprising the following amino acid sequence: RVSLTRHASFDFDTFSFYMDLKALRSDDTAVYFCAR (SEQ ID NO: 629), and comprises a VL comprising the amino acid sequence set forth in SEQ ID NO: 278. In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278, and comprises a FR3 of the VH comprising the following amino acid sequence: RVSLTRHASFDFDTFSFYMDLKALRSDDTAVYFCAR (SEQ ID NO: 629). In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477, and comprises a FR3 of the VH comprising the following amino acid sequence: RVSLTRHASFDFDTFSFYMDLKALRSDDTAVYFCAR (SEQ ID NO: 629), and comprises a VL comprising the amino acid sequence set forth in SEQ ID NO: 278.

The foregoing antibodies may further comprise a VH with one or more (e.g., 1, 2, 3, 4, 5, 6, 7, 8, 9, 10, 11, 12, 13, 14, 15, 16, 17, or 18) of the following amino acids at the indicated positions (position numbering according to Kabat): valine at position 5, glutamic acid at position 10, lysine at position 12, lysine at position 23, asparagine at position 28, arginine at position 30, tyrosine at position 32, threonine at position 68, methionine at position 69, histidine at position 72, phenylalanine at position 76, alanine at position 78, serine at position 82a, arginine at position 82b, threonine at position 89, tyrosine at position 99, glutamine at position 105, or methionine at position 108. In certain embodiments, the antibody may further comprise a VH with the following amino acids at the indicated positions (position numbering according to Kabat): asparagine at position 28, arginine at position 30, tyrosine at position 32, histidine at position 72 and tyrosine at position 99 (e.g., asparagine at position 28, arginine at position 30, tyrosine at position 32, histidine at position 73 and tyrosine at position 98, wherein the amino acid positions are with respect to SEQ ID NO: 477). In certain embodiments, the antibody or antigen-binding fragment thereof comprises VH CDRs and VL CDRs having the sequences set forth in: SEQ ID NOs.: 137, 138, 139, 140, 141, and 142, respectively, and comprise a VH with the following amino acids at the indicated positions (position numbering according to Kabat): asparagine at position 28, arginine at position 30, tyrosine at position 32, histidine at position 72 and tyrosine at position 99 (e.g., asparagine at position 28, arginine at position 30, tyrosine at position 32, histidine at position 73 and tyrosine at position 98, wherein the amino acid positions are with respect to SEQ ID NO: 477). In certain embodiments, the antibody or antigen-binding fragment thereof comprises VH CDRs and VL CDRs having the sequences set forth in: SEQ ID NOs.: 137, 138, 139, 140, 141, and 142, respectively, and comprise a VH with the following amino acids at the indicated positions (position numbering according to Kabat): asparagine at position 28, arginine at position 30, tyrosine at position 32, histidine at position 72, phenylalanine a position 74a and tyrosine at position 99 (e.g., asparagine at position 28, arginine at position 30, tyrosine at position 32, histidine at position 73, phenylalanine a position 76 and tyrosine at position 98, wherein the amino acid positions are with respect to SEQ ID NO: 477). In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278, and comprises a VH with the following amino acids at the indicated positions (position numbering according to Kabat): asparagine at position 28, arginine at position 30, tyrosine at position 32, histidine at position 72 and tyrosine at position 99 (e.g., asparagine at position 28, arginine at position 30, tyrosine at position 32, histidine at position 73 and tyrosine at position 98, wherein the amino acid positions are with respect to SEQ ID NO: 477). In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278, and comprises a VH with the following amino acids at the indicated positions (position numbering according to Kabat): asparagine at position 28, arginine at position 30, tyrosine at position 32, histidine at position 72, phenylalanine a position 74a and tyrosine at position 99 (e.g., asparagine at position 28, arginine at position 30, tyrosine at position 32, histidine at position 73, phenylalanine a position 76 and tyrosine at position 98, wherein the amino acid positions are with respect to SEQ ID NO: 477).

In some embodiments, the VL comprises one or more (e.g., 1, 2, 3, 4, 5, 6, 7, 8, 9, 10) of the following amino acids at the indicated positions (position numbering according to Kabat): arginine at position 18, lysine at position 39, proline at position 40, threonine at position 56, serine at position 65, threonine at position 72, serine at position 76, serine at position 77, threonine at position 99, glycine at position 99, asparagine at position 103, or isoleucine at position 106. In other embodiments, the VL comprises one or more (e.g., 1, 2, 3, 4, 5, 6, 7, 8, 9, 10) of the following amino acids at the indicated positions (position numbering according to Kabat): arginine at position 18, alanine at position 19, serine at position 65, threonine or histidine at position 72, lysine at position 74, serine at position 76, serine at position 77, phenylalanine at position 98, or glycine at position 99. In certain embodiments, the VL comprises an alanine at position 19 (Kabat numbering). In yet other embodiments, the VH comprises one or more of the following amino acids at the indicated positions (position numbering according to Kabat): histidine at position 72, phenylalanine at position 76, or phenylalanine at position 74a. In other embodiments, the VL comprises one or more (e.g., 1, 2, 3, 4, 5, 6, 7, 8) of the following amino acids at the indicated positions (position numbering according to Kabat): arginine at position 18, alanine at position 19, serine at position 65, threonine at position 72, serine at position 76, serine at position 77, phenylalanine at position 98, or glycine at position 99. In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278, and comprises a VH with the following amino acids at the indicated positions (position numbering according to Kabat): asparagine at position 28, arginine at position 30, tyrosine at position 32, histidine at position 72, phenylalanine at position 76, and phenylalanine at position 74a, and tyrosine at position 99 (e.g., asparagine at position 28, arginine at position 30, tyrosine at position 32, histidine at position 73, phenylalanine a position 76 and tyrosine at position 98, wherein the amino acid positions are with respect to SEQ ID NO: 477). In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278, and comprises a VL with an alanine at position 19 (Kabat numbering). In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278, and comprises a VH with the following amino acids at the indicated positions (position numbering according to Kabat): asparagine at position 28, arginine at position 30, tyrosine at position 32, histidine at position 72, phenylalanine at position 76, and phenylalanine at position 74a, and tyrosine at position 99, and comprises a VL with the following amino acids at the indicated positions (position numbering according to Kabat): alanine at position 19.

In certain embodiments, the VL comprises an amino acid sequence set forth in any one of SEQ ID NOs.: 332 to 342. In some cases, the antibody comprises a human IgG1 Fc region. In certain embodiments, the human IgG1 Fc region is IgG1m17 (SEQ ID NO: 348).

The foregoing antibody or antigen-binding fragment thereof further comprises a human IgG1 Fc region comprising (position numbered according to EU numbering): (i) aspartic acid at position 239, glutamic acid at position 332, alanine at position 236, leucine at position 330; (ii) aspartic acid at position 239, glutamic acid at position 332, leucine at position 428, and serine at position 434; (iii) aspartic acid at position 239, glutamic acid at position 332, alanine at position 236, leucine at position 428, and serine at position 434; (iv) aspartic acid at position 239, glutamic acid at position 332, leucine at position 330, leucine at position 428, and serine at position 434; (v) aspartic acid at position 239, glutamic acid at position 332, alanine at position 236, leucine at position 330, leucine at position 428, and serine at position 434; or (vi) leucine at position 243, proline at position 292, leucine at position 300, isoleucine at position 305, leucine at position 396, leucine at position 428, and serine at position 434. In certain embodiments, the antibody or antigen-binding fragment thereof further comprises a human IgG1 Fc region comprising (position numbered according to EU numbering): aspartic acid at position 239, glutamic acid at position 332, alanine at position 236, leucine at position 330, leucine at position 428, and serine at position 434. In certain embodiments, the antibody or antigen-binding fragment thereof comprises VH CDRs and VL CDRs having the sequences set forth in: SEQ ID NOs.: 137, 138, 139, 140, 141, and 142, respectively and further comprises a human IgG1 Fc region. In certain embodiments, the antibody or antigen-binding fragment thereof comprises VH CDRs and VL CDRs having the sequences set forth in: SEQ ID NOs.: 137, 138, 139, 140, 141, and 142, respectively and further comprises a human IgG1 Fc region comprising (position numbered according to EU numbering): aspartic acid at position 239, glutamic acid at position 332, alanine at position 236, leucine at position 330, leucine at position 428, and serine at position 434. In certain embodiments, antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278 and further comprises a human IgG1 Fc region. In certain embodiments, antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278 and further comprises a human IgG1 Fc region comprising (position numbered according to EU numbering): aspartic acid at position 239, glutamic acid at position 332, alanine at position 236, leucine at position 330, leucine at position 428, and serine at position 434.

In certain embodiments, the antibody comprises a human kappa light chain constant region. In some cases, the human kappa light chain constant region is Km3 (SEQ ID NO:351). In a certain embodiment, the human kappa light chain constant region is Km3 (SEQ ID NO: 351). In certain embodiments, the antibody or antigen-binding fragment thereof comprises VH CDRs and VL CDRs having the sequences set forth in: SEQ ID NOs.: 137, 138, 139, 140, 141, and 142, respectively and further comprises the human kappa light chain constant region Km3 (SEQ ID NO: 351). In certain embodiments, antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278 and further comprises the human kappa light chain constant region Km3 (SEQ ID NO: 351). In certain embodiments, antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278 and further comprises a human IgG1 Fc region comprising (position numbered according to EU numbering): aspartic acid at position 239, glutamic acid at position 332, alanine at position 236, leucine at position 330, leucine at position 428, and serine at position 434, and the human kappa light chain constant region Km3 (SEQ ID NO: 351).

In some embodiments, the antibody or antigen-binding fragment has improved, extended, enhanced or increased serum half-life in a mammal (e.g., in a non-human primate, in a human) compared to other anti-HIV antibodies, such as Antibody A. In some embodiments, the antibody or antigen-binding fragment has a serum half-life in a human of at least about 3 days, e.g., at least about 4 days, at least about 5 days, at least about 6 days, at least about 7 days, at least about 8 days, at least about 9 days, at least about 10 days, at least about 12 days, at least about 14 days, at least about 16 days, at least about 18 days, at least about 20 days, at least about 21 days, at least about 24 days, at least about 28 days, at least about 30 days, or longer. In some embodiments, the antibody or antigen-binding fragment has improved, enhanced or increased killing potency of HIV-infected cells compared to other anti-HIV antibodies, such as Antibody A. In certain embodiments, the antibody or antigen-binding fragment thereof comprises VH CDRs and VL CDRs having the sequences set forth in: SEQ ID NOs.: 137, 138, 139, 140, 141, and 142, respectively, and has improved, extended, enhanced or increased serum half-life in a mammal (e.g., in a non-human primate, in a human) compared to other anti-HIV antibodies, such as Antibody A. In certain embodiments, the antibody or antigen-binding fragment thereof comprises VH CDRs and VL CDRs having the sequences set forth in: SEQ ID NOs.: 137, 138, 139, 140, 141, and 142, respectively, and has improved, enhanced or increased killing potency of HIV-infected cells compared to other anti-HIV antibodies, such as Antibody A In another aspect, the disclosure provides an antibody that binds to HIV-1 Envelope glycoprotein gp120. The antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively; or SEQ ID NOs.: 153, 138, 154, 140, 141, and 142, respectively. The antibody comprises a human IgG1 Fc region comprising (position numbered according to EU numbering): (i) aspartic acid at position 239, glutamic acid at position 332, alanine at position 236, leucine at position 330; (ii) aspartic acid at position 239, glutamic acid at position 332, leucine at position 428, and serine at position 434; (iii) aspartic acid at position 239, glutamic acid at position 332, alanine at position 236, leucine at position 428, and serine at position 434; (iv) aspartic acid at position 239, glutamic acid at position 332, leucine at position 330, leucine at position 428, and serine at position 434; (v) aspartic acid at position 239, glutamic acid at position 332, alanine at position 236, leucine at position 330, leucine at position 428, and serine at position 434; or (vi) leucine at position 243, proline at position 292, leucine at position 300, isoleucine at position 305, leucine at position 396, leucine at position 428, and serine at position 434. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively, wherein the antibody comprises a human IgG1 Fc region comprising (position numbered according to EU numbering): aspartic acid at position 239, glutamic acid at position 332, alanine at position 236, leucine at position 330, leucine at position 428, and serine at position 434.

In certain embodiments, the antibody comprises a light chain comprising an alanine at position 19 (Kabat numbering). In some embodiments, the antibody comprises in framework region 3 (FR3) of the VH at positions corresponding to 74a, 74b, 74c, and 74d (Kabat numbering) the amino acid sequence set forth in SEQ ID NO:453 or SEQ ID NO: 627. In certain embodiments, the antibody comprises in framework region 3 (FR3) of the VH at positions corresponding to 74a, 74b, 74c, and 74d (Kabat numbering) the amino acid sequence set forth in SEQ ID NO: 627. In some embodiments, the antibody comprises a FR3 of the VH comprising the following amino acid sequence: RVSL-TRHASWDFDTFSFYMDLKALRSDDTAVYFCAR (SEQ ID NO: 628) or RVSLTRHASFDFDTFSFYMDLKA-LRSDDTAVYFCAR (SEQ ID NO: 629). In some embodiments, the antibody comprises a FR3 of the VH comprising the following amino acid sequence: RVSL-TRHASFDFDTFSFYMDLKALRSDDTAVYFCAR (SEQ ID NO: 629). In some embodiments, the antibody comprises an amino acid sequence set forth in any one of SEQ ID NOs.: 332 to 342. In some cases, the antibody comprises a VH and VL having the amino acid sequence set forth in SEQ ID NOs.: 182 and 223, respectively. In some cases, the antibody comprises a VH and VL having the amino acid sequence set forth in SEQ ID NOs.: 220 and 276, respectively. In certain embodiments, the antibody comprises a VH and VL having the amino acid sequence set forth in SEQ ID NOs.: 477 and 278, respectively. In other embodiments, the human IgG1 Fc region is IgG1m17 (SEQ ID NO: 348). In some embodiments, the antibody comprises a human kappa light chain constant region. In certain cases, the human kappa light chain constant region is Km3 (SEQ ID NO: 351).

In some embodiments, the antibody or antigen-binding fragment has improved, extended, enhanced or increased serum half-life in a mammal (e.g., in a non-human primate, in a human) compared to other anti-HIV antibodies, such as Antibody A and/or Antibody B. In some embodiments, the antibody or antigen-binding fragment has a serum half-life in a human of at least about 3 days, e.g., at least about 4 days, at least about 5 days, at least about 6 days, at least about 7 days, at least about 8 days, at least about 9 days, at least about 10 days, at least about 12 days, at least about 14 days, at least about 16 days, at least about 18 days, at least about 20 days, at least about 21 days, at least about 24 days, at least about 28 days, at least about 30 days, or longer. In some embodiments, the antibody has improved, increase, or enhanced killing potency of HIV-infected cells compared to other anti-HIV antibodies such as Antibody A and/or Antibody B. In certain embodiments, the antibody or antigen-binding fragment thereof comprises VH CDRs and VL CDRs having the sequences set forth in: SEQ ID NOs.: 137, 138, 139, 140, 141, and 142, respectively, wherein the antibody comprises a human IgG1 Fc region comprising (position numbered according to EU numbering): leucine at position 428, and serine at position 434, and has improved, extended, enhanced or increased serum half-life in a mammal (e.g., in a non-human primate, in a human) compared to other anti-HIV antibodies, such as Antibody A and/or Antibody B. In certain embodiments, the antibody or antigen-binding fragment thereof comprises VH CDRs and VL CDRs having the sequences set forth in: SEQ ID NOs.: 137, 138, 139, 140, 141, and 142, respectively, wherein the antibody comprises a human IgG1 Fc region comprising (position numbered according to EU numbering): aspartic acid at position 239, glutamic acid at position 332, alanine at position 236, leucine at position 330, and has improved, enhanced or increased killing potency of HIV-infected cells compared to other anti-HIV antibodies, such as Antibody A and/or Antibody B.

In yet another aspect, the disclosure provides an antibody or an antigen-binding fragment thereof, comprising a heavy chain variable region (VH) and a light chain variable region (VL), wherein the VH and VL comprise the amino acid sequences set forth, respectively: (1) SEQ ID NOs.: 184 and 223; (2) SEQ ID NOs.: 185 and 223; (3) SEQ ID NOs.: 182 and 225; (4) SEQ ID NOs.: 185 and 225; (5) SEQ ID NOs.: 186 and 223; (6) SEQ ID NOs.: 187 and 223; (7) SEQ ID NOs.: 188 and 223; (8) SEQ ID NOs.: 189 and 223; (9) SEQ ID NOs.: 190 and 223; (10) SEQ ID NOs.: 191 and 223; (11) SEQ ID NOs.: 192 and 223; (12) SEQ ID NOs.: 193 and 223; (13) SEQ ID NOs.: 194 and 223; (14) SEQ ID NOs.: 195 and 223; (15) SEQ ID NOs.: 196 and 223; (16) SEQ ID NOs.: 197 and 223; (17) SEQ ID NOs.: 198 and 223; (18) SEQ ID NOs.: 199 and 223; (19) SEQ ID NOs.: 200 and 223; (20) SEQ ID NOs.: 201 and 223; (21) SEQ ID NOs.: 202 and 223; (22) SEQ ID NOs.: 203 and 223; (23) SEQ ID NOs.: 204 and 223; (24) SEQ ID NOs.: 205 and 223; (25) SEQ ID NOs.: 206 and 223; (26) SEQ ID NOs.: 207 and 223; (27) SEQ ID NOs.: 208 and 223; (28) SEQ ID NOs.: 209 and 223; (29) SEQ ID NOs.: 182 and 226; (30) SEQ ID NOs.: 182 and 227; (31) SEQ ID NOs.: 182 and 229; (32) SEQ ID NOs.: 182 and 230; (33) SEQ ID NOs.: 182 and 231; (34) SEQ ID NOs.: 182 and 232; (35) SEQ ID NOs.: 182 and 233; (36) SEQ ID NOs.: 182 and 234; (37) SEQ ID NOs.: 182 and 235; (38) SEQ ID NOs.: 182 and 236; (39) SEQ ID NOs.: 182 and 237; (40) SEQ ID NOs.: 182 and 238; (41) SEQ ID NOs.: 182 and 239; (42) SEQ ID NOs.: 182 and 240; (43) SEQ ID NOs.: 182 and 241; (44) SEQ ID NOs.: 182 and 242; (45) SEQ ID NOs.: 182 and 243; (46) SEQ ID NOs.: 182 and 244; (47) SEQ ID NOs.: 182 and 245; (48) SEQ ID NOs.: 182 and 246; (49) SEQ ID NOs.: 182 and 247; (50) SEQ ID NOs.: 182 and 248; (51) SEQ ID NOs.: 182 and 249; (52) SEQ ID NOs.: 182 and 250; (53) SEQ ID NOs.: 182 and 251; (54) SEQ ID NOs.: 182 and 252; (55) SEQ ID NOs.: 182 and 253; (56) SEQ ID NOs.: 210 and 238; (57) SEQ ID NOs.: 211 and 238; (58) SEQ ID NOs.: 212 and 238; (59) SEQ ID NOs.: 210 and 240; (60) SEQ ID NOs.: 211 and 240; (61) SEQ ID NOs.: 212 and 240; (62) SEQ ID NOs.: 213 and 223; (63) SEQ ID NOs.: 214 and 223; (64) SEQ ID NOs.: 215 and 223; (65) SEQ ID NOs.: 216 and 223; (66) SEQ ID NOs.: 217 and 223; (67) SEQ ID NOs.: 218 and 223; (68) SEQ ID NOs.: 182 and 254; (69) SEQ ID NOs.: 213 and 254; (70) SEQ ID NOs.: 214 and 254; (71) SEQ ID NOs.: 215 and 254; (72) SEQ ID NOs.: 216 and 254; (73) SEQ ID NOs.: 217 and 254; (74) SEQ ID NOs.: 218 and 254; (75) SEQ ID NOs.: 182 and 255; (76) SEQ ID NOs.: 213 and 255; (77) SEQ ID NOs.: 214 and 255; (78) SEQ ID NOs.: 215 and 255; (79) SEQ ID NOs.: 216 and 255; (80) SEQ ID NOs.: 217 and 255; (81) SEQ ID NOs.: 218 and 255; (82) SEQ ID NOs.: 182 and 256; (83) SEQ ID NOs.: 213 and 256; (84) SEQ ID NOs.: 214 and 256; (85) SEQ ID NOs.: 215 and 256; (86) SEQ ID NOs.: 216 and 256; (87) SEQ ID NOs.: 217 and 256; (88) SEQ ID NOs.: 218 and 256; (89) SEQ ID NOs.: 182 and 257; (90) SEQ ID NOs.: 213 and 257; (91) SEQ ID NOs.: 214 and 257; (92) SEQ ID NOs.: 215 and 257; (93) SEQ ID NOs.: 216 and 257; (94) SEQ ID NOs.: 217 and 257; (95) SEQ ID NOs.: 218 and 257; (96) SEQ ID NOs.: 182 and 258; (97) SEQ ID NOs.: 213 and 258; (98) SEQ ID NOs.: 214 and 258; (99) SEQ ID NOs.: 215 and 258; (100) SEQ ID NOs.: 216 and 258; (101) SEQ ID NOs.: 217 and 258; (102) SEQ ID NOs.: 218 and 258; (103) SEQ ID NOs.: 182 and 259; (104) SEQ ID NOs.: 213 and 259; (105) SEQ ID NOs.: 214 and 259; (106) SEQ ID NOs.: 215 and 259; (107) SEQ ID NOs.: 216 and 259; (108) SEQ ID NOs.: 217 and 259; (109) SEQ ID NOs.: 218 and 259; (110) SEQ ID NOs.: 182 and 260; (111) SEQ ID NOs.: 182 and 261; (112) SEQ ID NOs.: 182 and 262; (113) SEQ ID NOs.: 182 and 263;

(114) SEQ ID NOs.: 182 and 264; (115) SEQ ID NOs.: 182 and 265; (116) SEQ ID NOs.: 182 and 266; (117) SEQ ID NOs.: 182 and 267; (118) SEQ ID NOs.: 182 and 268; (119) SEQ ID NOs.: 182 and 269; (120) SEQ ID NOs.: 182 and 270; (121) SEQ ID NOs.: 182 and 271; (122) SEQ ID NOs.: 182 and 272; (123) SEQ ID NOs.: 219 and 273; (124) SEQ ID NOs.: 191 and 274; (125) SEQ ID NOs.: 182 and 275; (126) SEQ ID NOs.: 220 and 277; (127) SEQ ID NOs.: 182 and 278; (128) SEQ ID NOs.: 182 and 279; (129) SEQ ID NOs.: 182 and 280; (130) SEQ ID NOs.: 182 and 281; (131) SEQ ID NOs.: 182 and 282; (132) SEQ ID NOs.: 221 and 228; (133) SEQ ID NOs.: 221 and 283; (134) SEQ ID NOs.: 182 and 284; (135) SEQ ID NOs.: 221 and 285; (136) SEQ ID NOs.: 182 and 286; (137) SEQ ID NOs.: 221 and 287; (138) SEQ ID NOs.: 221 and 288; (139) SEQ ID NOs.: 221 and 289; (140) SEQ ID NOs.: 182 and 290; (141) SEQ ID NOs.: 221 and 291; (142) SEQ ID NOs.: 182 and 292; (143) SEQ ID NOs.: 221 and 293; (144) SEQ ID NOs.: 221 and 294; (145) SEQ ID NOs.: 221 and 295; (146) SEQ ID NOs.: 182 and 296; (147) SEQ ID NOs.: 221 and 297; (148) SEQ ID NOs.: 182 and 298; (149) SEQ ID NOs.: 221 and 299; (150) SEQ ID NOs.: 221 and 300; (151) SEQ ID NOs.: 221 and 301; (152) SEQ ID NOs.: 182 and 302; (153) SEQ ID NOs.: 221 and 303; (154) SEQ ID NOs.: 182 and 304; (155) SEQ ID NOs.: 221 and 305; (156) SEQ ID NOs.: 182 and 306; (157) SEQ ID NOs.: 182 and 307; (158) SEQ ID NOs.: 182 and 308; (159) SEQ ID NOs.: 182 and 309; (160) SEQ ID NOs.: 220 and 310; (161) SEQ ID NOs.: 220 and 311; (162) SEQ ID NOs.: 182 and 228; (163) SEQ ID NOs.: 465 and 276; (164) SEQ ID NOs.: 466 and 276; (166) SEQ ID NOs.: 182 and 479; (167) SEQ ID NOs.: 465 and 479; (168) SEQ ID NOs.: 466 and 479; (169) SEQ ID NOs.: 182 and 480; (170) SEQ ID NOs.: 465 and 480; (171) SEQ ID NOs.: 466 and 480; (172) SEQ ID NOs.: 182 and 481; (173) SEQ ID NOs.: 182 and 482; (174) SEQ ID NOs.: 465 and 482; (175) SEQ ID NOs.: 466 and 482; (176) SEQ ID NOs.: 182 and 483; (177) SEQ ID NOs.: 182 and 484; (178) SEQ ID NOs.: 465 and 484; (179) SEQ ID NOs.: 466 and 484; (180) SEQ ID NOs.: 182 and 485; (181) SEQ ID NOs.: 182 and 486; (182) SEQ ID NOs.: 465 and 486; (183) SEQ ID NOs.: 466 and 486; (184) SEQ ID NOs.: 182 and 487; (185) SEQ ID NOs.: 182 and 488; (186) SEQ ID NOs.: 465 and 488; (187) SEQ ID NOs.: 466 and 488; (188) SEQ ID NOs.: 182 and 489; (189) SEQ ID NOs.: 465 and 489; (190) SEQ ID NOs.: 466 and 489; (191) SEQ ID NOs.: 182 and 491; (192) SEQ ID NOs.: 465 and 491; (193) SEQ ID NOs.: 466 and 491; (194) SEQ ID NOs.: 182 and 492; (195) SEQ ID NOs.: 465 and 492; (196) SEQ ID NOs.: 466 and 492; (197) SEQ ID NOs.: 182 and 493; (198) SEQ ID NOs.: 182 and 494; (199) SEQ ID NOs.: 465 and 494; (200) SEQ ID NOs.: 466 and 494; (201) SEQ ID NOs.: 182 and 277; (202) SEQ ID NOs.: 465 and 277; (203) SEQ ID NOs.: 466 and 277; (204) SEQ ID NOs.: 182 and 495; (205) SEQ ID NOs.: 465 and 495; (206) SEQ ID NOs.: 466 and 495; (207) SEQ ID NOs.: 182 and 496; (208) SEQ ID NOs.: 465 and 496; (209) SEQ ID NOs.: 466 and 496; (210) SEQ ID NOs.: 182 and 497; (211) SEQ ID NOs.: 465 and 497; (212) SEQ ID NOs.: 466 and 497; (213) SEQ ID NOs.: 182 and 498; (214) SEQ ID NOs.: 182 and 499; (215) SEQ ID NOs.: 465 and 499; (216) SEQ ID NOs.: 466 and 499; (217) SEQ ID NOs.: 182 and 500; (218) SEQ ID NOs.: 182 and 501; (219) SEQ ID NOs.: 465 and 501; (220) SEQ ID NOs.: 466 and 501; (221) SEQ ID NOs.: 182 and 502; (222) SEQ ID NOs.: 182 and 503; (223) SEQ ID NOs.: 182 and 504; (224) SEQ ID NOs.: 182 and 505; (225) SEQ ID NOs.: 182 and 506; (226) SEQ ID NOs.: 182 and 507; (227) SEQ ID NOs.: 182 and 508; (228) SEQ ID NOs.: 182 and 509; (229) SEQ ID NOs.: 182 and 510; (230) SEQ ID NOs.: 182 and 511; (231) SEQ ID NOs.: 182 and 512; (232) SEQ ID NOs.: 182 and 513; (233) SEQ ID NOs.: 182 and 514; (234) SEQ ID NOs.: 182 and 515; (235) SEQ ID NOs.: 467 and 223; (236) SEQ ID NOs.: 468 and 223; (237) SEQ ID NOs.: 469 and 223; (238) SEQ ID NOs.: 470 and 223; (239) SEQ ID NOs.: 471 and 223; (240) SEQ ID NOs.: 472 and 223; (241) SEQ ID NOs.: 473 and 223; (242) SEQ ID NOs.: 474 and 223; (243) SEQ ID NOs.: 475 and 223; (244) SEQ ID NOs.: 476 and 223; (245) SEQ ID NOs.: 182 and 516; (246) SEQ ID NOs.: 182 and 276; (247) SEQ ID NOs.: 182 and 569; (248) SEQ ID NOs.: 477 and 223; (249) SEQ ID NOs.: 477 and 278; (250) SEQ ID NOs.: 477 and 292; or (251) SEQ ID NOs.: 478 and 276.

In some embodiments, the VH and VL comprise the amino acid sequence set forth in SEQ ID NOs.: 182 and 275, respectively. In other embodiments, the VH and VL comprise the amino acid sequence set forth in SEQ ID NOs.: 182 and 278, respectively. In some embodiments, the VH and VL comprise the amino acid sequence set forth in SEQ ID NOs.: 182 and 223, respectively. In other embodiments, the VH and VL comprise the amino acid sequence set forth in SEQ ID NOs.: 182 and 292, respectively. In certain embodiments, the VH and VL comprise the amino acid sequence set forth in SEQ ID NOs.: 465 and 276, respectively. In other embodiments, the VH and VL comprise the amino acid sequence set forth in SEQ ID NOs.: 466 and 276, respectively. In certain embodiments, the VH and VL comprise the amino acid sequence set forth in SEQ ID NOs.: 182 and 491, respectively. In some embodiments, the VH and VL comprise the amino acid sequence set forth in SEQ ID NOs.: 465 and 491, respectively. In other embodiments, the VH and VL comprise the amino acid sequence set forth in SEQ ID NOs.: 466 and 491, respectively. In certain embodiments, the VH and VL comprise the amino acid sequence set forth in SEQ ID NOs.: 182 and 493, respectively. In some embodiments, the VH and VL comprise the amino acid sequence set forth in SEQ ID NOs.: 220 and 276, respectively. In other embodiments, the VH and VL comprise the amino acid sequence set forth in SEQ ID NOs.: 182 and 516, respectively. In other embodiments, the VH and VL comprise the amino acid sequence set forth in SEQ ID NOs.: 182 and 276, respectively. In other embodiments, the VH and VL comprise the amino acid sequence set forth in SEQ ID NOs.: 182 and 569, respectively. In some embodiments, the VH and VL comprise the amino acid sequence set forth in SEQ ID NOs.: 477 and 223, respectively. In some embodiments, the VH and VL comprise the amino acid sequence set forth in SEQ ID NOs.: 477 and 278, respectively. In some embodiments, the VH and VL comprise the amino acid sequence set forth in SEQ ID NOs.: 477 and 292, respectively. In other embodiments, the VH and VL comprise the amino acid sequence set forth in SEQ ID NOs.: 478 and 276, respectively.

In some embodiments, the antibody or antigen-binding fragment thereof comprises a VH that is at least 80%, at least 85%, at least 90%, at least 91%, at least 92%, at least 93%, at least 94%, at least 95%, at least 96%, at least 97%, at least 98%, at least 99%, or 100%, identical to an amino acid sequence selected from the group consisting of SEQ ID NOs: 181-221 and 465-478 and a VL that is at least 80%, at least 85%, at least 90%, at least 91%, at least 92%, at least 93%, at least 94%, at least 95%, at least 96%, at least 97%, at least 98%, at least 99%, or 100%, identical to an amino acid sequence selected from the group consisting of SEQ ID NOs: 222-311, 479-516 and 569. In some embodiments, the antibody or antigen-binding fragment thereof comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278.

In some embodiments, the antibody further comprises a human IgG1 Fc region. In some instances, the human IgG1 Fc region is IgG1m17 (SEQ ID NO:348). In certain embodiments, the antibody comprises a human IgG1 Fc region comprising (position numbered according to EU numbering): (i) aspartic acid at position 239, glutamic acid at position 332, alanine at position 236, leucine at position 330; (ii) aspartic acid at position 239, glutamic acid at position 332, leucine at position 428, and serine at position 434; (iii) aspartic acid at position 239, glutamic acid at position 332, alanine at position 236, leucine at position 428, and serine at position 434; (iv) aspartic acid at position 239, glutamic acid at position 332, leucine at position 330, leucine at position 428, and serine at position 434; (v) aspartic acid at position 239, glutamic acid at position 332, alanine at position 236, leucine at position 330, leucine at position 428, and serine at position 434; or (vi) leucine at position 243, proline at position 292, leucine at position 300, isoleucine at position 305, leucine at position 396, leucine at position 428, and serine at position 434. In some embodiments, the antibody comprises a human kappa light chain constant region. In certain cases, the human kappa light chain constant region is Km3 (SEQ ID NO: 351).

In some embodiments, the antibody or antigen-binding fragment has improved, extended, enhanced or increased serum half-life in a mammal (e.g., in a non-human primate, in a human) compared to other anti-HIV antibodies, such as Antibody A and/or Antibody B. In some embodiments, the antibody or antigen-binding fragment has a serum half-life in a human of at least about 3 days, e.g., at least about 4 days, at least about 5 days, at least about 6 days, at least about 7 days, at least about 8 days, at least about 9 days, at least about 10 days, at least about 12 days, at least about 14 days, at least about 16 days, at least about 18 days, at least about 20 days, at least about 21 days, at least about 24 days, at least about 28 days, at least about 30 days, or longer. In some embodiments, the antibody or antigen-binding fragment has improved, enhanced, or increased killing potency of HIV-infected cells compared to other anti-HIV antibodies such as Antibody A and/or Antibody B.

In another aspect, the disclosure provides an antibody comprising a heavy chain and a light chain, wherein the heavy chain and the light chain comprise any of the amino acid sequences set forth in Table X and XI, respectively.

In some embodiments, the heavy chain and light have the amino acid sequence set forth in SEQ ID NOs.: 2 and 49, respectively. In some embodiments, the heavy chain and light have the amino acid sequence set forth in SEQ ID NOs.: 2 and 100, respectively. In some embodiments, the heavy chain and light have the amino acid sequence set forth in SEQ ID NOs.: 42 and 101, respectively. In some embodiments, the heavy chain and light have the amino acid sequence set forth in SEQ ID NOs.: 2 and 103, respectively. In some embodiments, the heavy chain and light have the amino acid sequence set forth in SEQ ID NOs.: 2 and 117, respectively. In some embodiments, the heavy chain and light have the amino acid sequence set forth in SEQ ID NOs.: 517 and 101, respectively. In some embodiments, the heavy chain and light have the amino acid sequence set forth in SEQ ID NOs.: 518 and 101, respectively. In some embodiments, the heavy chain and light have the amino acid sequence set forth in SEQ ID NOs.: 2 and 542, respectively. In some embodiments, the heavy chain and light have the amino acid sequence set forth in SEQ ID NOs.: 517 and 542, respectively. In some embodiments, the heavy chain and light have the amino acid sequence set forth in SEQ ID NOs.: 518 and 542, respectively. In some embodiments, the heavy chain and light have the amino acid sequence set forth in SEQ ID NOs.: 2 and 544, respectively. In some embodiments, the heavy chain and light have the amino acid sequence set forth in SEQ ID NOs.: 2 and 567, respectively. In some embodiments, the heavy chain and light have the amino acid sequence set forth in SEQ ID NOs.: 2 and 568, respectively. In some embodiments, the heavy chain and light have the amino acid sequence set forth in SEQ ID NOs.: 529 and 49, respectively. In some embodiments, the heavy chain and light have the amino acid sequence set forth in SEQ ID NOs.: 529 and 103, respectively. In some embodiments, the heavy chain and light have the amino acid sequence set forth in SEQ ID NOs.: 529 and 117, respectively. In some embodiments, the heavy chain and light have the amino acid sequence set forth in SEQ ID NOs.: 530 and 101, respectively. In some embodiments, antibody comprises a heavy chain (HC) that is at least 80%, at least 85%, at least 90%, at least 91%, at least 92%, at least 93%, at least 94%, at least 95%, at least 96%, at least 97%, at least 98%, at least 99%, or 100%, identical to an amino acid sequence selected from the group consisting of SEQ ID NOs: 1-47 and 517-530 and a light chain (LC) that is at least 80%, at least 85%, at least 90%, at least 91%, at least 92%, at least 93%, at least 94%, at least 95%, at least 96%, at least 97%, at least 98%, at least 99%, or 100%, identical to an amino acid sequence selected from the group consisting of SEQ ID NOs: 48-136 and and 531-567. In certain embodiments, antibody comprises a heavy chain (HC) that is at least 80%, at least 85%, at least 90%, at least 91%, at least 92%, at least 93%, at least 94%, at least 95%, at least 96%, at least 97%, at least 98%, at least 99%, such as 100%, identical to the amino acid sequence set forth in SEQ ID NO: 529 and a light chain (LC) that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 103. In some embodiments, at least 50%, at least 60%, at least 70%, least 80%, at least 85%, at least 90%, or more, N-linked glycosylation sites in the VL are sialylated. In some embodiments, the N-linked glycosylation sites in the VL have a sialic acid occupancy (e.g., a glycan comprising one or two terminal sialic acid residues) of at least 40%, at least 50%, at least 60%, at least 70%, least 80%, at least 85%, at least 90%, or more.

In a related aspect, provided is an antibody or an antigen-binding fragment thereof that binds to human immunodeficiency virus-1 (HIV-1) Envelope glycoprotein gp120, the antibody or antigen-binding fragment thereof comprising (i) a heavy chain variable region (VH) comprising VH complementary determining regions 1-3 (CDRs 1-3) and (ii) a light chain variable region (VL) comprising VL CDRs 1-3, wherein the VH CDRs 1-3 and VL CDRs 1-3 have the sequences set forth in: (i) SEQ ID NOs.: 159, 138, 139, 140, 141, and 142, respectively; (ii) SEQ ID NOs.: 137, 160, 139, 140, 141, and 142, respectively; (iii) SEQ ID NOs.: 137, 161, 139, 140, 141, and 142, respectively; (iv) SEQ ID NOs.: 137, 162, 139, 140, 141, and 142, respectively; (v) SEQ ID NOs.: 137, 163, 139, 140, 141, and 142, respectively; (vi) SEQ ID NOs.: 137, 138, 164, 140, 141, and 142, respectively; (vii) SEQ ID NOs.: 159, 138, 164, 140, 141, and 142, respectively; (viii) SEQ ID NOs.: 137, 138, 139, 140, 165, and 142, respectively; (ix) SEQ ID NOs.: 137, 138, 139, 140, 166, and 142, respectively; (x) SEQ ID NOs.: 137, 138, 139, 140, 167, and 142, respectively; (xi) SEQ ID NOs.: 137, 138, 139, 140, 168, and 142, respectively; (xii) SEQ ID NOs.: 137, 138, 154, 140, 141, and 142, respectively, or (xiii) SEQ ID NOs.: 137, 138, 139, 140, 141, and 142, respectively, and wherein at least 50%, at least 60%, at least 70%, least 80%, at least 85%, at least 90%, or more, N-linked glycosylation sites in the VL are sialylated. In certain embodiments, is an antibody or an antigen-binding fragment thereof that binds to human immunodeficiency virus-1 (HIV-1) Envelope glycoprotein gp120, the antibody or antigen-binding fragment thereof comprising (i) a heavy chain variable region (VH) comprising VH complementary determining regions 1-3 (CDRs 1-3) and (ii) a light chain variable region (VL) comprising VL CDRs 1-3, wherein the VH CDRs 1-3 and VL CDRs 1-3 have the sequences set forth in: SEQ ID NOs.: 137, 138, 139, 140, 141, and 142, respectively and wherein at least 50%, at least 60%, at least 70%, least 80%, at least 85%, at least 90%, or more, N-linked glycosylation sites in the VL are sialylated. In certain embodiments, is an antibody or an antigen-binding fragment thereof that binds to human immunodeficiency virus-1 (HIV-1) Envelope glycoprotein gp120, the antibody or antigen-binding fragment thereof comprising (i) a heavy chain variable region (VH) comprising VH complementary determining regions 1-3 (CDRs 1-3) and (ii) a light chain variable region (VL) comprising VL CDRs 1-3, wherein the VH CDRs 1-3 and VL CDRs 1-3 have the sequences set forth in: SEQ ID NOs.: 137, 138, 139, 140, 141, and 142, respectively, wherein comprises a VH with the following amino acids at the indicated positions (position numbering according to Kabat): asparagine at position 28, arginine at position 30, tyrosine at position 32, histidine at position 72, phenylalanine at position 76, and phenylalanine at position 74a, and tyrosine at position 99 (e.g., asparagine at position 28, arginine at position 30, tyrosine at position 32, histidine at position 73, phenylalanine a position 76 and tyrosine at position 98, wherein the amino acid positions are with respect to SEQ ID NO: 477), and wherein at least 50%, at least 60%, at least 70%, at least 80%, at least 85%, at least 90%, or more, N-linked glycosylation sites in the VL are sialylated. In some embodiments, the N-linked glycosylation sites in the VL have a sialic acid occupancy (e.g., one or two terminal sialic acid residues) of at least 40%, at least 50%, at least 60%, at least 70%, least 80%, at least 85%, at least 90%, or more. In some embodiments, the asparagine at VL amino acid position 72 according to Kabat numbering (N72) is sialylated. In some embodiments, the sialylated N-linked glycosylation sites in the VL comprise from 1 to 5 sialic acid residues, e.g., from 1 to 4 sialic acid residues, e.g., from 1 to 3 sialic acid residues, e.g., from 1 to 2 sialic acid residues. In some embodiments, the VL are sialylated with N-acetylneuraminic acid (NANA). In some embodiments, the sialic acid residues are present in biantennary structures. In some embodiments, the sialic acid residues are present in complex N-linked glycan structures. In some embodiments, the sialic acid residues are present in hybrid N-linked glycan structures.

In a further aspect, provided is a bispecific antibody comprising: a first antigen binding arm that binds to gp120, the first antigen binding arm comprising: (i) the VH CDRs 1-3 and the VL CDRs 1-3; or (ii) the VH and the VL of any one or claims 1 to 63; and a second antigen binding arm binding to a second antigen. In certain embodiments, is a bispecific antibody comprising: a first antigen binding arm that binds to gp120, the first antigen binding arm comprising the VH CDRs 1-3 and the VL CDRs 1-3 as set forth in SEQ ID NOs.: 137, 138, 139, 140, 141, and 142, respectively and a second antigen binding arm binding to a second antigen. In certain embodiments, is a bispecific antibody comprising: a first antigen binding arm that binds to gp120, the first antigen binding arm comprising the VH and the VL comprising the amino acid sequences set forth in SEQ ID NOs: 477 and 278, respectively, and a second antigen binding arm binding to a second antigen. In some embodiments, the second antigen is selected from the group consisting of CD3, FcγRI (CD64), FcγRII (CD32), FcγRIII (CD16); CD89, CCR5, CD4, gp41, killer cell immunoglobulin like receptor, three Ig domains and long cytoplasmic tail 1 (KIR3DL1), killer cell immunoglobulin like receptor, three Ig domains and long cytoplasmic tail 1 (KIR3DL1), killer cell immunoglobulin like receptor, two Ig domains and long cytoplasmic tail 1 (KIR2DL1), killer cell immunoglobulin like receptor, two Ig domains and long cytoplasmic tail 2 (KIR2DL2), killer cell immunoglobulin like receptor, two Ig domains and long cytoplasmic tail 3 (KIR2DL3), killer cell lectin like receptor C1 (KLRC1), killer cell lectin like receptor C2 (KLRC2), killer cell lectin like receptor C3 (KLRC3), killer cell lectin like receptor C4 (KLRC4), killer cell lectin like receptor D1 (KLRD1), killer cell lectin like receptor K1 (KLRK1), natural cytotoxicity triggering receptor 3 (NCR3 or NKp30), natural cytotoxicity triggering receptor 2 (NCR2 or NK-p44), natural cytotoxicity triggering receptor 1 (NCR1 or NK-p46), CD226 (DNAM-1), cytotoxic and regulatory T cell molecule (CRTAM or CD355), signaling lymphocytic activation molecule family member 1 (SLAMF1), CD48 (SLAMF2), lymphocyte antigen 9 (LY9 or SLAMF3), CD244 (2B4 or SLAMF4), CD84 (SLAMF5), SLAM family member 6 (SLAMF6 or NTB-A), SLAM family member 7 (SLAMF7 or CRACC), CD27 (TNFRSF7), semaphorin 4D (SEMA4D or CD100), and CD160 (NK1), and a second epitope of gp120.

The disclosure also provides a pharmaceutical composition comprising an antibody or antigen-binding fragment described herein, and a pharmaceutically acceptable carrier.

In certain embodiments, the pharmaceutical composition further comprises a second agent (e.g., one or more additional agents) for treating an HIV infection. In some cases, the pharmaceutical composition further comprises a latency reversing agent (LRA) or an immunostimulatory agent, e.g., an agonist of a toll-like receptor (TLR), e.g., an agonist of TLR1, TLR2, TLR3, TLR4, TLR5, TLR6, TLR7, TLR8, TLR9, and/or TLR10. In some embodiments, the LRA is a TLR7 agonist or a TLR8 agonist. In certain instances, the TLR7 agonist is selected from the group consisting of vesatolimod, imiquimod, and resiquimod. In some embodiments, the pharmaceutical composition further comprises an antibody or antigen-binding fragment thereof that binds, inhibits, and/or neutralizes HIV. In some embodiments, the pharmaceutical composition further comprises a second antibody or antigen-binding fragment thereof that binds, inhibits, and/or neutralizes HIV, wherein the second antibody or antigen-binding fragment thereof does not compete with the antibody or antigen-binding fragment, as described herein, for binding to gp120. In some embodiments, the second antibody or antigen-binding fragment thereof that binds, inhibits, and/or neutralizes HIV, competes with or comprises VH and VL variable domains of a broadly neutralizing antibody (bNAb) against HIV. In some embodiments, the second antibody or antigen-binding fragment thereof that binds, inhibits, and/or neutralizes HIV, binds to an epitope or region of gp120 selected from the group consisting of: (i) third variable loop (V3) and/or high mannose patch comprising a N332 oligomannose glycan; (ii) second variable loop (V2) and/or Env trimer apex; (iii) gp120/gp41 interface; or (iv) silent face of gp120. In some embodiments, the second antibody or antigen-binding fragment thereof that binds, inhibits, and/or neutralizes HIV, binds to an epitope or region of gp120 in the third variable loop (V3) and/or high mannose patch comprising a N332 oligomannose glycan and competes with or comprises VH and VL regions from an antibody selected from the group consisting of GS-9722, PGT-121.60, PGT-121.66, PGT-121, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the second antibody or antigen-binding fragment thereof that binds, inhibits, and/or neutralizes HIV, binds to an epitope or region of gp120 in the second variable loop (V2) and/or Env trimer apex and competes with or comprises VH and VL regions from an antibody selected from the group consisting of PG9, PG16, PGC14, PGG14, PGT-142, PGT-143, PGT-144, PGT-145, CH01, CH59, PGDM1400, CAP256, CAP256-VRC26.08, CAP256-VRC26.09, CAP256-VRC26.25, PCT64-24E and VRC38.01. In some embodiments, the second antibody or antigen-binding fragment binds to an epitope or region of gp120 in the gp120/gp41 interface and competes with or comprises VH and VL regions from an antibody selected from the group consisting of PGT-151, CAP248-2B, 35O22, 8ANC195, ACS202, VRC34 and VRC34.01. In some embodiments, the second antibody or antigen-binding fragment thereof that binds, inhibits, and/or neutralizes HIV, binds to an epitope or region of the gp120 silent face and competes with or comprises VH and VL regions from an antibody selected from the group consisting of VRC-PG05 and SF12. In some embodiments, the second antibody or antigen-binding fragment thereof that binds, inhibits, and/or neutralizes HIV, binds to an epitope or region of gp41 in the membrane proximal region (MPER). In some embodiments, the second antibody or antigen-binding fragment thereof that binds, inhibits, and/or neutralizes HIV, binds to an epitope or region of gp41 in the membrane proximal region (MPER) and competes with or comprises VH and VL regions from an antibody selected from the group consisting of 10E8, 10E8v4, 10E8-5R-100cF, 4E10, DH511.11P, 2F5, 7b2, and LN01. In some embodiments, the second antibody or antigen-binding fragment thereof that binds, inhibits, and/or neutralizes HIV, binds to an epitope or region of the gp41 fusion peptide and competes with or comprises VH and VL regions from an antibody selected from the group consisting of VRC34 and ACS202. In some embodiments, the second or antigen-binding fragment thereof that binds, inhibits, and/or neutralizes HIV comprises the VH and VL of PGT121.60 or PGT121.66. In certain cases, the antibody or antigen-binding fragment thereof that binds, inhibits, and/or neutralizes HIV comprises the VH and VL of SEQ ID NO: 443 and/or SEQ ID NO: 447. In other cases, the antibody or antigen-binding fragment thereof that binds, inhibits, and/or neutralizes HIV comprises the VH within SEQ ID NO: 454 and the VL within SEQ ID NO: 455. In yet other cases, the antibody or antigen-binding fragment thereof that binds, inhibits, and/or neutralizes HIV comprises the VH within SEQ ID NO: 454 and the VL within SEQ ID NO: 456.

In another aspect, the disclosure provides nucleic acids, nucleotides, or polynucleotides encoding an antibody or antigen-binding fragment disclosed herein. In some embodiments, the nucleic acid or nucleic acids comprise DNA, cDNA or mRNA. In some embodiments, the nucleic acid or nucleic acids encode a VH selected from the group consisting of SEQ ID NOs: 181-221 and 465-478 and having at least 80%, at least 85%, at least 90%, at least 91%, at least 92%, at least 93%, at least 94%, at least 95%, at least 96%, at least 97%, at least 98%, at least 99%, or 100%, identical to a nucleic acid sequence selected from the group consisting of SEQ ID NOs: 572-581; and encode a VL selected from the group consisting of SEQ ID NOs: 222-311, 479-516 and 569 and having at least 80%, at least 85%, at least 90%, at least 91%, at least 92%, at least 93%, at least 94%, at least 95%, at least 96%, at least 97%, at least 98%, at least 99%, or 100%, identical to a nucleic acid sequence selected from the group consisting of SEQ ID NOs: 582-595. In some embodiments, the nucleic acid or nucleic acids encode a HC selected from the group consisting of SEQ ID NOs: 1-47 and 517-530 and having at least 80%, at least 85%, at least 90%, at least 91%, at least 92%, at least 93%, at least 94%, at least 95%, at least 96%, at least 97%, at least 98%, at least 99%, or 100%, identical to a nucleic acid sequence selected from the group consisting of SEQ ID NOs: 596-605; and encode a LC selected from the group consisting of SEQ ID NOs: 48-136 and 531-567 and having at least 80%, at least 85%, at least 90%, at least 91%, at least 92%, at least 93%, at least 94%, at least 95%, at least 96%, at least 97%, at least 98%, at least 99%, or 100%, identical to a nucleic acid sequence selected from the group consisting of SEQ ID NOs: 606-619. In another aspect, the disclosure provides an expression vector or expression vectors comprising the nucleic acid or nucleic acids operably linked to a regulatory sequence. In some embodiments, the expression vector or expression vectors comprise a plasmid vector or a viral vector. Further provided are pharmaceutical compositions comprising the nucleic acid or nucleic acids, or the expression vector or expression vector, as described herein, and a pharmaceutically acceptable carrier. Further provided are lipid nanoparticles comprising the nucleic acid or nucleic acids, or the expression vector or expression vector, as described herein.

In yet another aspect, the disclosure provides a host cell, or population of host cells, comprising the nucleic acid or nucleic acids, or the expression vector or expression vectors, described herein. In some embodiments, the cell or population of cells comprises a eukaryotic cell. In some embodiments, the cell or population of cells comprises a mammalian cell, a human cell, a hamster cell, an insect cell, a plant cell or a yeast cell. In some embodiments, the mammalian cell is a Chinese Hamster Ovary (CHO) cell or a human cell, e.g., a human embryonic kidney cell or a human B-cell. In some embodiments, the cell predominantly sialylates N-linked glycosylation sites in the variable domains (Fv) of the expressed antigen binding molecules, e.g., expressed antibodies or antigen binding fragments. In some embodiments, the cell sialylates at least 50%, at least 55%, at least 60%, at least 65%, at least 70%, at least 75%, at least 80%, at least 85%, at least 90%, at least 91%, at least 92%, at least 93%, at least 94%, at least 95%, or more, N-linked glycosylation sites in the variable domains (Fv) of expressed antibodies or antigen-binding fragments. In some embodiments, the cell sialylates at least 50%, at least 60%, at least 70%, least 80%, at least 85%, at least 90%, at least 91%, at least 92%, at least 93%, at least 94%, at least 95%, or more, N-linked glycosylation sites in the VL of expressed antibodies or antigen-binding fragments. In some embodiments, the asparagine at VL amino acid position 72 according to Kabat numbering (N72) is sialylated. In some embodiments, the sialylated N-linked glycosylation sites in the VL comprise from 1 to 5 sialic acid residues, e.g., from 1 to 4 sialic acid residues, e.g., from 1 to 3 sialic acid residues, e.g., from 1 to 2 sialic acid residues. In some embodiments, the VL are sialylated with N-acetylneuraminic acid (NANA). In some embodiments, the sialic acid residues are present in biantennary structures. In some embodiments, the sialic acid residues are present in complex N-linked glycan structures. In some embodiments, the sialic acid residues are present in hybrid N-linked glycan structures.

In yet another aspect, provided herein are antigen-binding fragments of the antibodies described herein. In some embodiments, the antigen-binding fragments are selected from the group consisting of a scFv, sc(Fv)$_2$, Fab, F(ab)$_2$, Fab', F(ab')$_2$, Facb or Fv fragment. Further provided is a chimeric antigen receptor (CAR) including an antigen-binding antibody fragment as described herein. In certain embodiments, the CAR is expressed on a T-cell, a B-cell, a macrophage or a NK cell. Further provided is a CAR T-cell including a CAR as described herein. In certain embodiments, the T-cell is a CD4+ T-cell, a CD8+ T-cell, or a combination thereof. In certain embodiments, the cell is administered to a subject. In certain embodiments, the cell is autologous. In certain embodiments, the cell is allogeneic.

In yet another aspect, provided herein is a method of producing an antibody or antigen-binding fragment thereof described herein. The method involves culturing the host cell in a cell culture and isolating the antibody or antigen-binding fragment from the cell culture. In certain cases, the method further involves formulating the antibody or antigen-binding fragment into a sterile pharmaceutical composition suitable for administration to a human subject.

In another aspect, the disclosure provides a method of treating or preventing HIV in a human subject in need thereof. The method involves administering to the subject an effective amount of an antibody or antigen-binding fragment thereof, or a pharmaceutical composition described herein.

In some embodiments, the method further comprises administering to the subject a second agent (e.g., one or more additional agents) for treating an HIV infection. In some cases, the method comprises administering to the subject a TLR7 agonist. In certain instances, the TLR7 agonist is selected from the group consisting of vesatolimod, imiquimod, and resiquimod. In some embodiments, the method further comprises administering to the subject an antibody or antigen-binding fragment thereof that binds, inhibits, and/or neutralizes HIV. In some embodiments, the method further comprises administering a second antibody or antigen-binding fragment thereof that binds, inhibits, and/or neutralizes HIV, wherein the second antibody or antigen-binding fragment thereof does not compete with the antibody or antigen-binding fragment, as described herein, for binding to gp120. In some embodiments, the second antibody or antigen-binding fragment thereof that binds, inhibits, and/or neutralizes HIV, competes with or comprises VH and VL variable domains of a broadly neutralizing antibody (bNAb) against HIV. In some embodiments, the second antibody or antigen-binding fragment thereof that binds, inhibits, and/or neutralizes HIV, binds to an epitope or region of gp120 selected from the group consisting of: (i) third variable loop (V3) and/or high mannose patch comprising a N332 oligomannose glycan; (ii) second variable loop (V2) and/or Env trimer apex; (iii) gp120/gp41 interface; or (iv) silent face of gp120. In some embodiments, the second antibody or antigen-binding fragment thereof that binds, inhibits, and/or neutralizes HIV, binds to an epitope or region of gp120 in the third variable loop (V3) and/or high mannose patch comprising a N332 oligomannose glycan and competes with or comprises VH and VL regions from an antibody selected from the group consisting of GS-9722, GS-9722, PGT-121.60, PGT-121.66, PGT-121, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the second antibody or antigen-binding fragment thereof that binds, inhibits, and/or neutralizes HIV, binds to an epitope or region of gp120 in the second variable loop (V2) and/or Env trimer apex and competes with or comprises VH and VL regions from an antibody selected from the group consisting of PG9, PG16, PGC14, PGG14, PGT-142, PGT-143, PGT-144, PGT-145, CH01, CH59, PGDM1400, CAP256, CAP256-VRC26.08, CAP256-VRC26.09, CAP256-VRC26.25, PCT64-24E and VRC38.01. In some embodiments, the second antibody or antigen-binding fragment binds to an epitope or region of gp120 in the gp120/gp41 interface and competes with or comprises VH and VL regions from an antibody selected from the group consisting of PGT-151, CAP248-2B, 35O22, 8ANC195, ACS202, VRC34 and VRC34.01. In some embodiments, the second antibody or antigen-binding fragment thereof that binds, inhibits, and/or neutralizes HIV, binds to an epitope or region of the gp120 silent face and competes with or comprises VH and VL regions from an antibody selected from the group consisting of VRC-PG05 and SF12. In some embodiments, the second antibody or antigen-binding fragment thereof that binds, inhibits, and/or neutralizes HIV, binds to an epitope or region of gp41 in the membrane proximal region (MPER). In some embodiments, the second antibody or antigen-binding fragment thereof that binds, inhibits, and/or neutralizes HIV, binds to an epitope or region of gp41 in the membrane proximal region (MPER) and competes with or comprises VH and VL regions from an antibody selected from the group consisting of 10E8, 10E8v4, 10E8-5R-100cF, 4E10, DH511.11P, 2F5, 7b2, and LN01. In some embodiments, the second antibody or antigen-binding fragment thereof that binds, inhibits, and/or neutralizes HIV, binds to an epitope or region of the gp41 fusion peptide and competes with or comprises VH and VL regions from an antibody selected from the group consisting of VRC34 and ACS202. In some embodiments, the second or antigen-binding fragment thereof that binds, inhibits, and/or neutralizes HIV comprises the VH and VL of PGT121.60 or PGT121.66. In certain cases, the antibody or antigen-binding fragment thereof that binds, inhibits, and/or neutralizes HIV comprises the VH and VL of SEQ ID NO: 443 and/or SEQ ID NO: 447. In other cases, the antibody or antigen-binding fragment thereof that binds, inhibits, and/or neutralizes HIV comprises the VH within SEQ ID NO: 454 and the VL within SEQ ID NO: 455. In yet other cases, the antibody or antigen-binding fragment thereof that binds, inhibits, and/or neutralizes HIV comprises the VH within SEQ ID NO: 454 and the VL within SEQ ID NO:456. In some embodiments, the antibody or antigen-binding fragments, as described herein, are co-administered to a human subject with an anti-HIV vaccine. In various embodiments, the anti-HIV vaccine comprises a viral vaccine. In certain embodiments, the viral vaccine is from a virus selected from the group consisting of an arenavirus, an adenovirus, a poxvirus, and a rhabdovirus.

In another aspect, the disclosure relates to a method of inhibiting HIV in a human subject in need thereof. The method involves administering to the subject an effective amount of an antibody or antigen-binding fragment thereof, or a pharmaceutical composition described herein.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, the exemplary methods and materials are described below. All publications, patent applications, patents, and other references mentioned herein are incorporated by reference in their entirety. In case of conflict, the present application, including definitions, will control. The materials, methods, and examples are illustrative only and not intended to be limiting.

BRIEF DESCRIPTION OF THE DRAWINGS

FIG. 5 illustrates a dot plot representation of the neutralization profile of three mAbs. Antibodies were screened against a panel of 142 HIV-1 pseudotyped with Env from subtype B plasma isolates. In parentheses (Breadth/Median IC95), defined the same as for FIG. 4. Each dot represents neutralization IC95 for one virus. (1) Antibody A (87%/1.72 μg/mL); (2) Antibody A-1 (87%/1.09 μg/mL); (3) 1.52.64-1 (86%/2.0 μg/mL).

DETAILED DESCRIPTION

Figure 1:
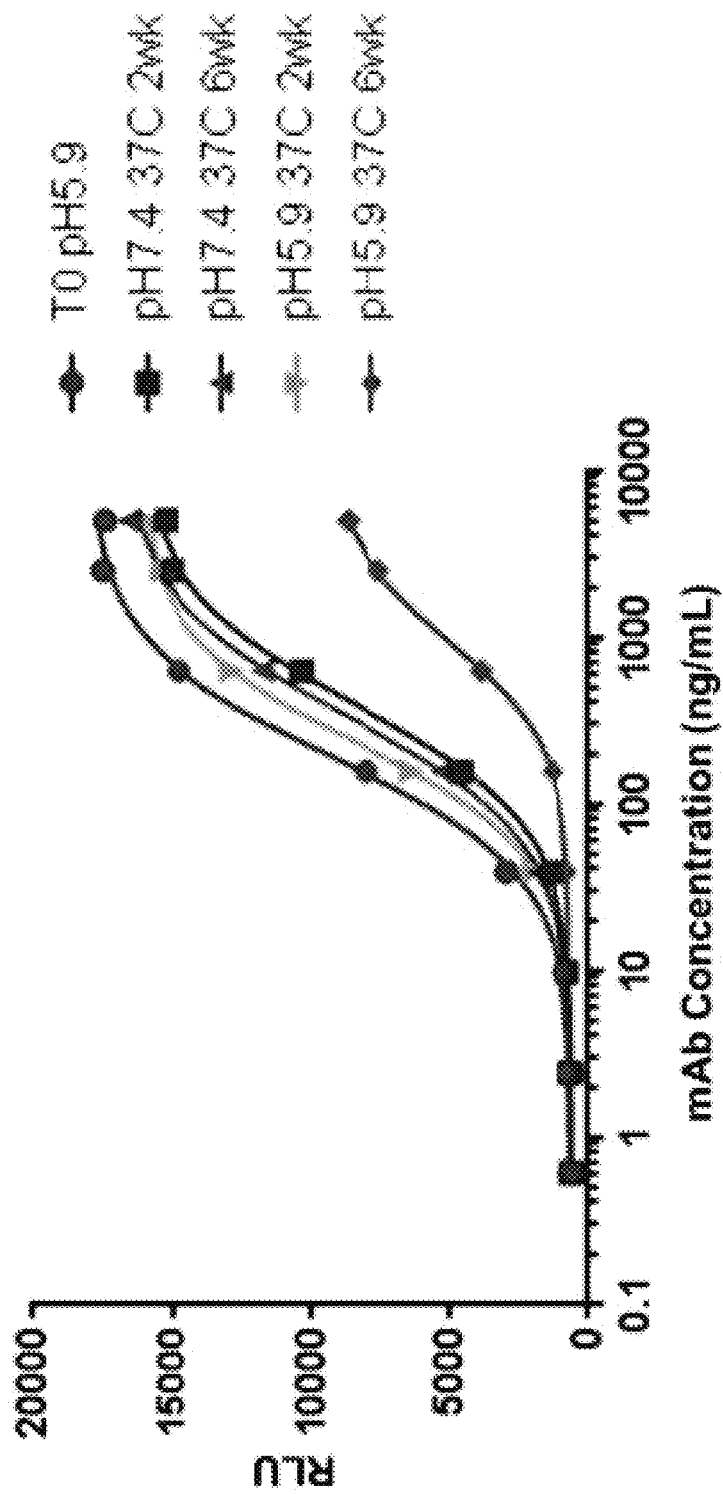
FIG. 1 illustrates the results of an ADCC reporter assay conducted on the antibody A-1 stress panel. The sample stressed at 37° C. in pH 5.9 formulation buffer for six weeks showed a large reduction in activity relative to other samples.

This disclosure provides antibodies that target human immunodeficiency virus (HIV). The antibodies described herein bind to HIV envelope (Env) protein gp120 (gp120). In some embodiments, these are HIV neutralizing antibodies. In certain embodiments, these antibodies broadly neutralize HIV.

HIV-1 is the main family of HIV and accounts for 95% of all infections worldwide. HIV-2 is mainly seen in a few West African countries. HIV viruses are divided into specific groups, M, N, O and P, of which M is the "major" group and responsible for majority of HIV/AIDS globally. Based on their genetic sequence, Group M is further subdivided into subtypes (also called clades) with prevalence in distinct geographical locations.

A Group M "subtype" or "clade" is a subtype of HIV-1 group M defined by genetic sequence data. Examples of Group M subtypes include Subtypes A-K. Some of the subtypes are known to be more virulent or are resistant to different medications. There are also "circulating recombinant forms" or CRFs derived from recombination between viruses of different subtypes, which are each given a number. CRF12_BF, for example, is a recombination between subtypes B and F. Subtype A is common in West Africa. Subtype B is the dominant form in Europe, the Americas, Japan, Thailand, and Australia. Subtype C is the dominant form in Southern Africa, Eastern Africa, India, Nepal, and parts of China. Subtype D is generally only seen in Eastern and central Africa. Subtype E has never been identified as a nonrecombinant, only recombined with subtype A as CRF01_AE. Subtype F has been found in central Africa, South America and Eastern Europe. Subtype G (and the CRF02_AG) have been found in Africa and central Europe. Subtype H is limited to central Africa. Subtype I was originally used to describe a strain that is now accounted for as CRF04_cpx, with the cpx for a "complex" recombination of several subtypes. Subtype J is primarily found in North, Central and West Africa, and the Caribbean. Subtype K is limited to the Democratic Republic of Congo and Cameroon. These subtypes are sometimes further split into sub-subtypes such as A1 and A2 or F1 and F2. In 2015, the strain CRF19, a recombinant of subtype A, subtype D, and subtype G, with a subtype D protease was found to be strongly associated with rapid progression to AIDS in Cuba.

This disclosure provides neutralizing antibodies (e.g., broadly neutralizing Abs) that target the gp120 polypeptide on the surface of HIV-infected cells. Without being bound to any hypothesis, neutralizing antibodies against viral envelope proteins may provide adaptive immune defense against HIV-1 exposure by blocking the infection of susceptible cells. Broad neutralization indicates that the antibodies can neutralize HIV-1 isolates from different clades. Thus, the antibodies encompassed by this disclosure have cross-clade binding activity.

HIV Envelope Glycoprotein Gp120

Envelope glycoprotein gp120 (or gp120) is a 120 kDa glycoprotein that is part of the outer layer of HIV. It presents itself as viral membrane spikes consisting of three molecules of gp120 linked together and anchored to the membrane by gp41 protein. Gp120 is essential for viral infection as it facilitates HIV entry into the host cell through its interaction with cell surface receptors. These receptors include DC-SIGN, Heparan Sulfate Proteoglycan, the CD4 receptor, C-C motif chemokine receptor 5 (CCR5) and C-X-C motif chemokine receptor 4 (CXCR4). Binding to CD4 on helper T-cells induces the start of a cascade of conformational changes in gp120 and gp41 that lead to the fusion of the virus with the host cell membrane.

Gp120 is encoded by the HIV env gene. The env gene encodes a gene product of around 850 amino acids. The primary env product is the protein gp160, which gets cleaved to gp120 (about 480 amino acids) and gp41 (about 345 amino acids) in the endoplasmic reticulum by the cellular protease furin.

The amino acid sequence of an exemplary gp160 polypeptide of HIV clone WITO is provided below (the V3 hypervariable loop is boldened and the N332 potential N-linked glycosylation site is boldened and underlined):

(SEQ ID NO: 343)
MKVMGIKKNYQHLWRWGIMLLGMLMMSSAAEQLWVTVYYGVPVWREANT
TLFCASDAKAYDTEVHNVWATHACVPTDPNPQEVVMGNVTEDFNMWKNN
MVEQMHEDIISLWDQSLKPCVKLTPLCVTLHCTNVTISSTNGSTANVTM
REEMKNCSFNTTTVIRDKIQKEYALFYKLDIVPIEGKNTNTSYRLINCN
TSVITQACPKVSFEPIPIHYCAPAGFAILKCNNKTFNGKGPCRNVSTVQ
CTHGIKPVVSTQLLLNGSLAEEDIIIRSENFTNNGKNIIVQLKEPVKIN
CTRPGNNTRRSINIGPGRAFYATGAIIGDIRKAHCNISTEQWNNTLTQI
VDKLREQFGNKTIIFNQSSGGDPEVVMHTFNCGGEFFYCNSTQLFNSTW
FNNGTSTWNSTADNITLPCRIKQVINMWQEVGKAMYAPPIRGQIDCSSN
ITGLILTRDGGSNSSQNETFRPGGGNMKDNWRSELYKYKVVKIEPLGIA
PTRAKRRVVQREKRAVTLGAVFLGFLGAAGSTMGAASLTLTVQARLLLS
GIVQQQSNLLRAIEAQQHMLQLTVWGIKQLQARVLAIERYLKDQQLLGI
WGCSGKLICTTTVPWNTSWSNKSYDYIWNNMTWMQWEREIDNYTGFIYT
LIEESQNQQEKNELELLELDKWASLWNWFNITNWLWYIKLFIMIIGGLV
GLRIVCAVLSIVNRVRQGYSPLSFQTRLPNPRGPDRPEETEGEGGERDR

-continued

DRSARLVNGFLAIIWDDLRSLCLFSYHRLRDLLLIVARVVEILGRRGWE
ILKYWWNLLKYWSQELKNSAVSLLNVTAIAVAEGTDRVIEIVQRAVRAI
LHIPTRIRQGFERALL

The amino acid sequence of an exemplary gp120 polypeptide is provided below (the V3 hypervariable loop is boldened and the N332 potential N-linked glycosylation site is boldened and underlined):

(SEQ ID NO: 344)
AEQLWVTVYYGVPVWREANTTLFCASDAKAYDTEVHNVWATHACVPTDP
NPQEVVMGNVTEDFNMWKNNMVEQMHEDIISLWDQSLKPCVKLTPLCVT
LHCTNVTISSTNGSTANVTMREEMKNCSFNTTTVIRDKIQKEYALFYKL
DIVPIEGKNTNTSYRLINCNTSVITQACPKVSFEPIPIHYCAPAGFAIL
KCNNKTFNGKGPCRNVSTVQCTHGIKPVVSTQLLLNGSLAEEDIIIRSE
NFTNNGKNIIVQLKEPVKINCTRPGNNTRRSINIGPGRAFYATGAIIGD
IRKAHCNISTEQWNNTLIQIVDKLREQFGNKTIIFNQSSGGDPEVVMHT
FNCGGEFFYCNSTQLFNSTWFNNGTSTWNSTADNITLPCRIKQVINMWQ
EVGKAMYAPPIRGQIDCSSNITGLILTRDGGSNSSQNETFRPGGGNMKD
NWRSELYKYKVVKIEPLGIAPTRAKRRVVQREKR

The amino acid sequence of another exemplary gp120 polypeptide (see, bioafrica.net/proteomics/ENV-GP120prot.html) is provided below (the V3 hypervariable loop is boldened and the N332 potential N-linked glycosylation site is boldened and underlined):

(SEQ ID NO: 345)
TEKLWVTVYY GVPVWKEATT TLFCASDAKA YDTEVHNVWA
THACVPTDPN PQEVVLVNVT ENFNMWKNDM VEQMHEDIIS
LWDQSLKPCV KLTPLCVSLK CTDLKNDTNT NSSSGRMIME
KGEIKNCSFN ISTSIRGKVQ KEYAFFYKLD IIPIDNDTTS
YKLTSCNTSV ITQACPKVSF EPIPIHYCAP AGFAILKCNN
KTFNGTGPCT NVSTVQCTHG IRPVVSTQLL LNGSLAEEEV
VIRSVNFTDN AKTIIVQLNT SVEINCTRPN NNTRKRIRIQ
RGPGRAFVTI GKIGNMRQAH CNISRAKWNN TLKQIASKLR
EQFGNNKTII FKQSSGGDPE IVTHSFNCGG EFFYCNSTQL
FNSTWFNSTW STEGSNNTEG SDTITLPCRI KQIINMWQKV
GKAMYAPPIS GQIRCSSNIT GLLLTRDGGN SNNESEIFRP
GGGDMRDNWR SELYKYKVVK IEPLGVAPTK AKRRVVQREK R

Genomic diversity among independent human immunodeficiency virus type 1 (HIV-1) isolates, to a lesser degree among sequential isolates from the same patients, and even within a single patient isolate is a well-known feature of HIV-1. Although this sequence heterogeneity is distributed throughout the genome, most of the heterogeneity is located in the env gene. Comparison of predicted amino acid sequences from several different isolates has shown that sequence heterogeneity is clustered in five hypervariable regions (designated V1 through V5) of the surface glycoprotein, gp120. The V3 region, although only 35 amino acids long, exhibits considerable sequence variability. In spite of this variability, the V3 region includes determinants that mediate interactions with CD4+ cells. The increase in gp120 variability results in higher levels of viral replication, suggesting an increase in viral fitness in individuals infected by diverse HIV-1 variants. Without being bound to theory, the higher levels of viral replication may be due to host immune response pressure (e.g., immune response escape) and/or to adaptation to each individual host to maximize the rate of virus replication. Variability in potential N-linked glycosylation sites (PNGSs) also result in increased viral fitness. PNGSs allow for the binding of long-chain carbohydrates to the high variable regions of gp120. Thus, the number and precise location of PNGSs in env might affect the fitness of the virus, or the replication capacity of each virus variant, by providing more or less sensitivity to host immune responses, particularly the neutralizing antibodies.

A consensus sequence of the V3 region of gp120 (Milich et al., *J. Virol.*, 67(9):5623-5634 (1993)) is provided below:

(SEQ ID NO: 346)
CTRPNNNTRKSIHIGPGRAFYTTGEIIGDIRQAHC.

Antibody variants described herein bind to the CD4 binding site (CD4bs) of HIV gp120. The CD4 binding site (CD4bs) involves structurally conserved sites located within the β1-α1, loop D, β20-β21 (bridging sheet) and β24-α5 of gp120, which determine the CD4 binding and are involved in the epitopes of CD4bs-directed antibodies (Qiao, et al., *Antiviral Res.* 2016 August; 132:252-61). The CD4bs of gp120 forms conformational epitopes recognized by anti-CD4bs antibodies involving one or more amino acid residues selected from Thr278, Asp279, Ala281, Thr283, Asp368, Trp427, Glu460, Ser461, Glu462, Leu452, Leu453 and Arg476. The amino acid residues and position numbering is with reference to HXB2 subtype B HIV-1 isolate, which corresponds to residues 1-511 of NCBI Ref Seq No. NP 057856.1, provided below. Residues Thr278, Asp279, Asn280, Ala281, Thr283, Asp368, Trp427, Leu452, Leu453, Gly459, Glu464, Ser465, Glu466, Ile467, Gly472, Gly473 and Arg476, which can contribute to the gp120 CD4bs, are boldened and underlined:

(SEQ ID NO: 571)
MRVKEKYQHLWRWGWRWGTMLLGMLMICSATEKLWVTVYYGVPVWKEAT

TTLFCASDAKAYDTEVHNVWATHACVPTDPNPQEVVLVNVTENFNMWKN

DMVEQMHEDIISLWDQSLKPCVKLTPLCVSLKCTDLKNDTNTNSSSGRM

IMEKGEIKNCSFNISTSIRGKVQKEYAFFYKLDIIPIDNDTTSYKLTSC

NTSVITQACPKVSFEPIPIHYCAPAGFAILKCNNKTFNGTGPCTNVSTV

QCTHGIRPVVSTQLLLNGSLAEEEVVIRSVNFTDNAKTIIVQLNTSVEI

NCTRPNNNTRKRIRIQRGPGRAFVTIGKIGNMRQAHCNISRAKWNNTLK

QIASKLREQFGNNKTIIFKQSSGGDPEIVTHSFNCGGEFFYCNSTQLFN

STWFNSTWSTEGSNNTEGSDTITLPCRIKQIINMWQKVGKAMYAPPISG

QIRCSSNITGLLLTRDGGNSNNESEIFRPGGGDMRDNWRSELYKYKVVK

IEPLGVAPTKAKRRVVQREKR.

Tridimensional models depicting amino acid residues contributing to the gp120 CD4bs are provided, e.g., in Canducci, et al., *Retrovirology*. 2009 Jan. 15; 6:4; Falkowska, et al., *J Virol.* 2012 April; 86(8):4394-403; and Li, et al., *J. Virol.* 2012 October; 86(20):11231-41; Gristick, et al., *Nat Struct Mol Biol.* 2016 October; 23(10):906-915; Kwon, et al., *Nat Struct Mol Biol.* 2015 July; 22(7):522-31; Liu, et al., *Nat Struct Mol Biol.* 2017 April; 24(4):370-378; Chen, et al., *Science.* 2009 Nov. 20; 326(5956):1123-7 and Lyumkis, et al., *Science.* 2013 Dec. 20; 342(6165):1484-90. In some embodiments, the antibody variants described herein compete with anti-CD4bs antibodies b12, CH103, 1NC9, 12A12, VRC01, VRC07-523, N6, 3BNC117, NIH45-46 and/or PGV04 (VRC-PG04) for binding to gp120 CD4bs. In some embodiments, the antibody variants described herein bind to an overlapping or identical epitope to the epitope bound by anti-CD4bs antibodies b12, CH103, 1NC9, 12A12, VRC01, VRC07-523, N6, 3BNC117, NIH45-46 and/or PGV04 (VRC-PG04).

Anti-Gp120 Antibodies

This disclosure provides anti-gp120 antibodies. In certain embodiments, these antibodies bind to HIV-1 antigens expressed on a cell surface and eliminate or kill the infected cell.

In certain embodiments, these antibodies are neutralizing antibodies (e.g., monoclonal) that target HIV-1. A "neutralizing antibody" is one that neutralizes the ability of HIV to initiate and/or perpetuate an infection in a host and/or in target cells in vitro. The disclosure provides neutralizing monoclonal human antibodies, wherein the antibody recognizes an antigen from HIV, e.g., a gp120 polypeptide. In certain embodiments, a "neutralizing antibody" may inhibit the entry of HIV-1 virus, e.g., SF162 and/or JR-CSF, with a neutralization index >1.5 or >2.0 (Kostrikis L G et al., *J. Virol.*, 70(1): 445-458 (1996)).

In some embodiments, these antibodies are broadly neutralizing antibodies (e.g., monoclonal) that target HIV-1. By "broadly neutralizing antibodies" are meant antibodies that neutralize more than one HIV-1 virus species (from diverse clades and different strains within a clade) in a neutralization assay. A broadly neutralizing antibody may neutralize at least 2, 3, 4, 5, 6, 7, 8, 9 or more different strains of HIV-1, the strains belonging to the same or different clades. In some embodiments, a broad neutralizing antibody may neutralize multiple HIV-1 species belonging to at least 2, 3, 4, 5, or 6 different clades. In certain embodiments, the inhibitory concentration of the antibody may be less than about 0.0001 µg/mL, less than about 0.001 µg/mL, less than about 0.01 µg/mL, less than about 0.1 µg/mL, less than about 0.5 µg/mL, less than about 1.0 µg/mL, less than about 5 µg/mL, less than about 10 µg/mL, less than about 25 µg/mL, less than about 50 µg/mL, or less than about 100 µg/mL to neutralize about 50% of the input virus in the neutralization assay.

In certain embodiments, these antibodies show broad and potent activity and fall within the group of highly active agonistic anti-CD4 binding site antibodies (HAADs). Such antibodies mimic binding of the host receptor CD4 protein to gp120. In certain embodiments, the antibodies or antigen-binding fragments thereof comprise in their heavy chain variable region tryptophan at position 50; asparagine at position 58; arginine at position 71; and tryptophan at position 100 (position numbering according to Kabat). In certain embodiments, the antibodies or antigen-binding fragments thereof comprise in their light chain variable region tryptophan or phenylalanine at position 67; and glutamic acid at position 96 (position numbering according to Kabat). In certain embodiments, the antibodies or antigen-binding fragments thereof comprise in their light chain variable region tryptophan at position 67 and glutamic acid at position 96 (position numbering according to Kabat). In certain instances, the light chain variable region includes an N-linked glycosylation site in framework region 3. In certain embodiments, the antibodies or antigen-binding fragments thereof comprise in their heavy chain variable region tryptophan at position 50; asparagine at position 58; arginine at position 71; and tryptophan at position 100; and comprise in their light chain variable region tryptophan or phenylalanine at position 67; and glutamic acid at position 96 (position numbering according to Kabat). In certain embodiments, the antibodies or antigen-binding fragments thereof comprise in their heavy chain variable region tryptophan at position 50; asparagine at position 58; arginine at position 71; and tryptophan at position 100; and comprise in their light chain variable region tryptophan at position 67 and glutamic acid at position 96 (position numbering according to Kabat). In certain embodiments, the antibodies or antigen-binding fragments thereof comprise VH CDRs and VL CDRs having the sequences set forth in: SEQ ID NOs.: 137, 138, 139, 140, 141, and 142, respectively, and further comprise in their heavy chain variable region tryptophan at position 50; asparagine at position 58; arginine at position 71; and tryptophan at position 100; and comprise in their light chain variable region tryptophan at position 67 and glutamic acid at position 96 (position numbering according to Kabat). In certain embodiments, the antibodies or antigen-binding fragments thereof comprise VH CDRs and VL CDRs having the sequences set forth in: SEQ ID NOs.: 137, 138, 139, 140, 141, and 142, respectively, and further comprise in their light chain variable region tryptophan at position 67 and glutamic acid at position 96 (position numbering according to Kabat). In certain embodiments, the antibodies or antigen-binding fragments thereof comprise VH CDRs and VL CDRs having the sequences set forth in: SEQ ID NOs.: 137, 138, 139, 140, 141, and 142, respectively, and further comprise in their heavy chain variable region tryptophan at position 50; asparagine at position 58; arginine at position 71; and tryptophan at position 100; and comprise in their light chain variable region tryptophan at position 67 and glutamic acid at position 96 (position numbering according to Kabat) and in their light chain variable region tryptophan at position 67 and glutamic acid at position 96 (position numbering according to Kabat).

Exemplary HAADs include the antibodies disclosed herein as well as those disclosed in Scheid et al., *Science*, 333:1633-1637 (2011); and West et al., *Proc. Natl. Acad. Sci. USA*, E2083-E2090 (2012). Studies have shown that Antibody A and Antibody B are of the same B cell lineage from one patient and differ at four amino acid positions in their light chain variable regions and at ten amino acid positions in their heavy chain variable regions (Scheid et al., 2011). The exemplary antibodies include but are not limited to Antibody A, Antibody B, and an antibody comprising the heavy chain of Antibody A and the light chain of Antibody B.

Table I provides the complementarity determining regions (CDRs) of the heavy chain variable region and the light chain variable region of Antibody A and Antibody B according to the Kabat, Chothia, and IMGT definitions.

TABLE I

CDRs of Antibody A and Antibody B

| AntibodyA CDR | Kabat | Chothia | IMGT |
|---|---|---|---|
| VH-CDR1 | DYFIH (SEQ ID NO: 137) | GYNIRDY (SEQ ID NO: 143) | GYNIRDYF (SEQ ID NO: 149) |
| VH-CDR2 | WINPKTGQPNNPRQFQG (SEQ ID NO: 138) | PKTG (SEQ ID NO: 144) | INPKTGQP (SEQ ID NO: 150) |
| VH-CDR3 | QRSDYWDFDV (SEQ ID NO: 139) | RSDYWDFD (SEQ ID NO: 145) | ARQRSDYWDFDV (SEQ ID NO: 151) |
| VL-CDR1 | QANGYLN (SEQ ID NO: 140) | NGY (SEQ ID NO: 146) | GY (SEQ ID NO: 152) |
| VL-CDR2 | DGSKLER (SEQ ID NO: 141) | DGS (SEQ ID NO: 147) | DGS (SEQ ID NO: 147) |
| VL-CDR3 | QVYEF (SEQ ID NO: 142) | YE (SEQ ID NO: 148) | QVYEF (SEQ ID NO: 142) |
| Antibody B CDR | Kabat | Chothia | IMGT |
| VH-CDR1 | DHFIH (SEQ ID NO: 153) | GYKISDH (SEQ ID NO: 155) | GYKISDHF (SEQ ID NO: 157) |
| VH-CDR2 | WINPKTGQPNNPRQFQG (SEQ ID NO: 138) | PKTG (SEQ ID NO: 144) | INPKTGQP (SEQ ID NO: 150) |
| VH-CDR3 | QRSDFWDFDV (SEQ ID NO: 154) | RSDFWDFD (SEQ ID NO: 156) | ARQRSDFWDFDV (SEQ ID NO: 158) |
| VL-CDR1 | QANGYLN (SEQ ID NO: 140) | NGY (SEQ ID NO: 146) | GY (SEQ ID NO: 152) |
| VL-CDR2 | DGSKLER (SEQ ID NO: 141) | DGS (SEQ ID NO: 147) | DGS (SEQ ID NO: 147) |
| VL-CDR3 | QVYEF (SEQ ID NO: 142) | YE (SEQ ID NO: 148) | QVYEF (SEQ ID NO: 142) |

The complementarity determining regions (CDRs) of exemplary antibodies of the present application are provided below: the CDRs according to the Kabat definition (Tables II and V), Chothia definition (Tables III and VI), and IMGT definition (Tables IV and VII). Antibodies comprising the CDRs listed below are encompassed by the present application.

Figure 4:
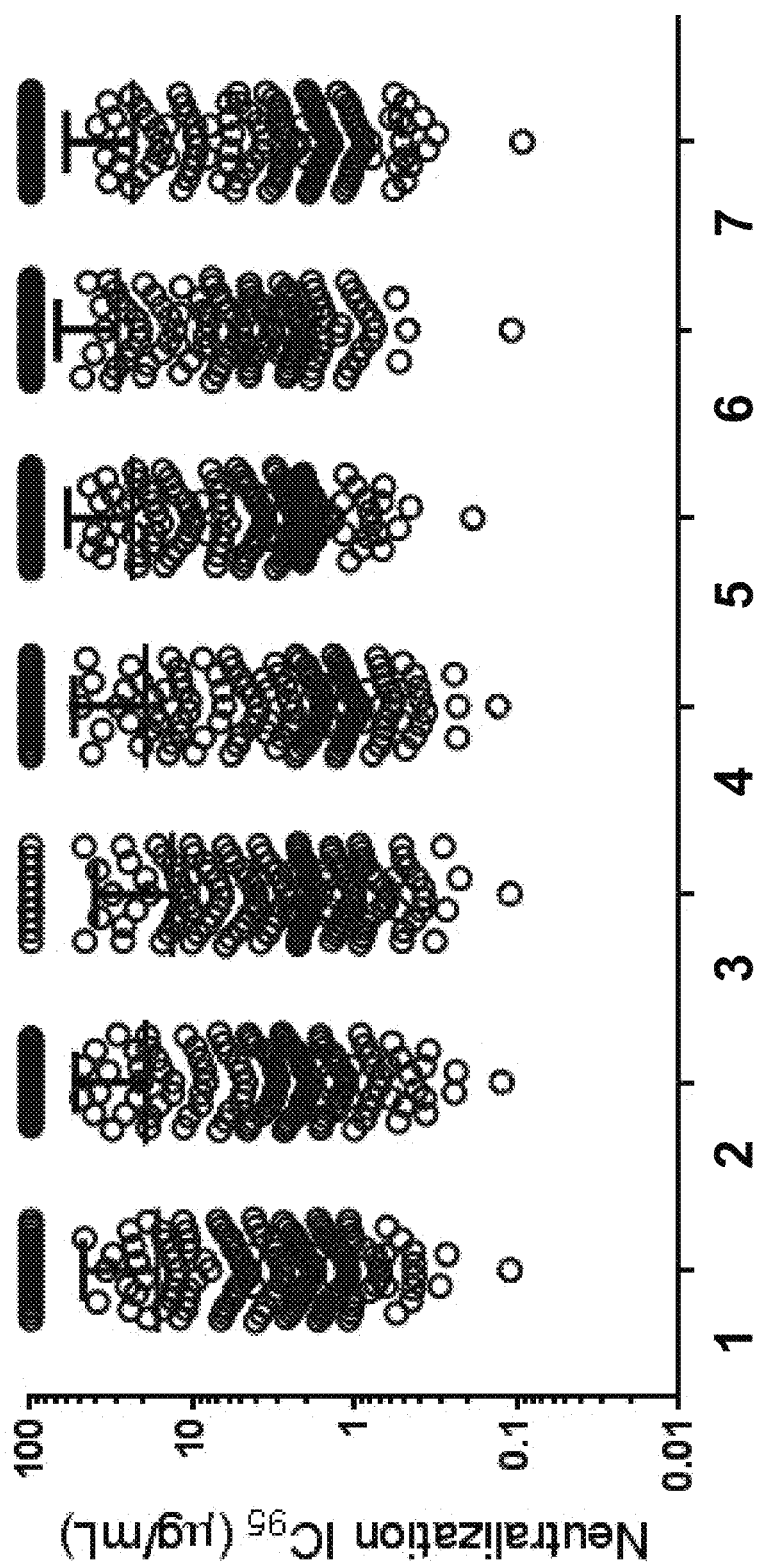
FIG. 4 illustrates a dot plot representation of the neutralization profile of seven mAb variants. Antibodies were screened against a panel of 152 patient-derived HIV-1 pseudotyped with Env from subtype B plasma viral clones (n=133) and isolates (n=19). Each dot represents neutralization IC95 for one virus. In parentheses (Breadth/Median IC95). Breadth represents % viruses neutralized with an IC95 ≤50 mg/mL. Median IC95 values calculated using viruses with IC95 ≤50 mg/mL. (1) Antibody A-1 (89%/2.66 μg/mL); (2) 1.1.90-1 (86%/2.59 μg/mL); (3) 1.1.64-1 (92%/2.25 μg/mL); (4) 1.1.10-1 (86%/1.93 μg/mL); (5) 1.52.1-1 (83%/3.66 μg/mL); (6) 1.52.90 (78%/4.42 μg/mL); (7) 1.1.138-1 (82%/2.59 μg/mL).
Figure 5:
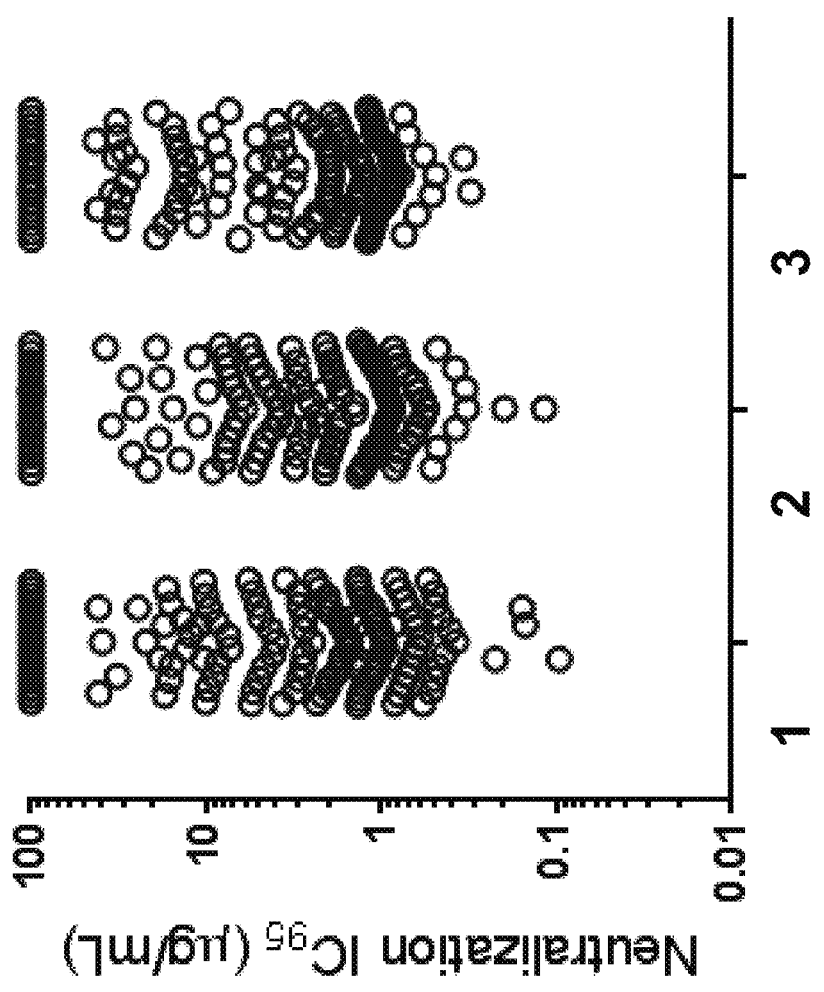

In certain embodiments, the anti-gp120 antibodies or gp120-binding fragments thereof of this disclosure in addition to including the six CDRs of Antibody A or Antibody B according to the Kabat, Chothia, or IMGT definitions provided below also include tryptophan (W) or phenylalanine (F) at Kabat position 74a, aspartic acid (D) at Kabat position 74b, phenylalanine (F) at Kabat position 74c, and aspartic acid (D) at Kabat position 74d; i.e., the WDFD (SEQ ID NO: 453) or the FDFD (SEQ ID NO: 627) sequence in framework region 3 of their VH or heavy chain domain. In certain embodiments, the anti-gp120 antibodies or gp120-binding fragments thereof of this disclosure in addition to including the six CDRs of Antibody A, also include phenylalanine (F) at Kabat position 74a, aspartic acid (D) at Kabat position 74b, phenylalanine (F) at Kabat position 74c, and aspartic acid (D) at Kabat position 74d; i.e., the FDFD (SEQ ID NO: 627) sequence in framework region 3 of their VH or heavy chain domain. Crystallographic studies have shown that framework region 3 at VH Kabat position numbers 74a, 74b, 74c and 74d form part of the paratope of the herein described antibody variants, directly contacting the antigen target, gp120. See, e.g., Lee, et al., *Immunity* (2017) 46(4): 690-702 (FIG. 1G, identifying residue W71d); Klein, et al., *Cell.* (2013) 153(1):126-38 (FIGS. 4 and 5); and Zhou, et al., (2013) *Immunity* (2013) 39 245-258 (Table 1); ribbon diagrams of crystallized structures of 5V8L, 5V8M, 4JPV and 4LSV can be viewed at rcsb.org.

TABLE II

CDR Definitions (Kabat) of Antibodies

| VH-CDR1 | VH-CDR2 | VH-CDR3 | VL-CDR1 | VL-CDR2 | VL-CDR3 |
|---|---|---|---|---|---|
| DYFIH (SEQ ID NO: 137) | WINPKTGQPNNPRQFQG (SEQ ID NO: 138) | QRSDYWDFDV (SEQ ID NO: 139) | QANGYLN (SEQ ID NO: 140) | DGSKLER (SEQ ID NO: 141) | QVYEF (SEQ ID NO: 142) |
| DYFMH (SEQ ID NO: 159) | WINPKTGQPNNPRQFQG (SEQ ID NO: 138) | QRSDYWDFDV (SEQ ID NO: 139) | QANGYLN (SEQ ID NO: 140) | DGSKLER (SEQ ID NO: 141) | QVYEF (SEQ ID NO: 142) |
| DYFIH (SEQ ID NO: 137) | WINPKWGQPNNPRQFQG (SEQ ID NO: 160) | QRSDYWDFDV (SEQ ID NO: 139) | QANGYLN (SEQ ID NO: 140) | DGSKLER (SEQ ID NO: 141) | QVYEF (SEQ ID NO: 142) |
| DYFIH (SEQ ID NO: 137) | WINPKGGQPNNPRQFQG (SEQ ID NO: 161) | QRSDYWDFDV (SEQ ID NO: 139) | QANGYLN (SEQ ID NO: 140) | DGSKLER (SEQ ID NO: 141) | QVYEF (SEQ ID NO: 142) |
| DYFIH (SEQ ID NO: 137) | WINPKAGQPNNPRQFQG (SEQ ID NO: 162) | QRSDYWDFDV (SEQ ID NO: 139) | QANGYLN (SEQ ID NO: 140) | DGSKLER (SEQ ID NO: 141) | QVYEF (SEQ ID NO: 142) |
| DYFIH (SEQ ID NO: 137) | WINPKHGQPNNPRQFQG (SEQ ID NO: 163) | QRSDYWDFDV (SEQ ID NO: 139) | QANGYLN (SEQ ID NO: 140) | DGSKLER (SEQ ID NO: 141) | QVYEF (SEQ ID NO: 142) |
| DYFIH (SEQ ID NO: 137) | WINPKTGQPNNPRQFQG (SEQ ID NO: 138) | QRTDYWDFDV (SEQ ID NO: 164) | QANGYLN (SEQ ID NO: 140) | DGSKLER (SEQ ID NO: 141) | QVYEF (SEQ ID NO: 142) |
| DYFMH (SEQ ID NO: 159) | WINPKTGQPNNPRQFQG (SEQ ID NO: 138) | QRTDYWDFDV (SEQ ID NO: 164) | QANGYLN (SEQ ID NO: 140) | DGSKLER (SEQ ID NO: 141) | QVYEF (SEQ ID NO: 142) |
| DYFIH (SEQ ID NO: 137) | WINPKTGQPNNPRQFQG (SEQ ID NO: 138) | QRSDYWDFDV (SEQ ID NO: 139) | QANGYLN (SEQ ID NO: 140) | DASKLER (SEQ ID NO: 165) | QVYEF (SEQ ID NO: 142) |
| DYFIH (SEQ ID NO: 137) | WINPKTGQPNNPRQFQG (SEQ ID NO: 138) | QRSDYWDFDV (SEQ ID NO: 139) | QANGYLN (SEQ ID NO: 140) | DGSNLER (SEQ ID NO: 166) | QVYEF (SEQ ID NO: 142) |
| DYFIH (SEQ ID NO: 137) | WINPKTGQPNNPRQFQG (SEQ ID NO: 138) | QRSDYWDFDV (SEQ ID NO: 139) | QANGYLN (SEQ ID NO: 140) | DGSKLET (SEQ ID NO: 167) | QVYEF (SEQ ID NO: 142) |
| DYFIH (SEQ ID NO: 137) | WINPKTGQPNNPRQFQG (SEQ ID NO: 138) | QRSDYWDFDV (SEQ ID NO: 139) | QANGYLN (SEQ ID NO: 140) | DASNLER (SEQ ID NO: 168) | QVYEF (SEQ ID NO: 142) |
| DYFIH (SEQ ID NO: 153) | WINPKTGQPNNPRQFQG (SEQ ID NO: 138) | QRSDYWDFDV (SEQ ID NO: 139) | QANGYLN (SEQ ID NO: 140) | DGSKLER (SEQ ID NO: 141) | QVYEF (SEQ ID NO: 142) |

TABLE II-continued

CDR Definitions (Kabat) of Antibodies

| VH-CDR1 | VH-CDR2 | VH-CDR3 | VL-CDR1 | VL-CDR2 | VL-CDR3 |
|---|---|---|---|---|---|
| DHFIH (SEQ ID NO: 137) | WINPKTGQPNNPRQFQG (SEQ ID NO: 138) | QRSDFWDFDV (SEQ ID NO: 154) | QANGYLN (SEQ ID NO: 140) | DGSKLER (SEQ ID NO: 141) | QVYEF (SEQ ID NO: 142) |
| DYFIH (SEQ ID NO: 137) | WINPKTGQPNNPRQFQG (SEQ ID NO: 138) | QRSDFWDFDV (SEQ ID NO: 154) | QATGYLN (SEQ ID NO: 570) | DGSKLER (SEQ ID NO: 141) | QVYEF (SEQ ID NO: 142) |

TABLE III

CDR Definitions (Chothia) of Antibodies

| VH-CDR1 | VH-CDR2 | VH-CDR3 | VL-CDR1 | VL-CDR2 | VL-CDR3 |
|---|---|---|---|---|---|
| GYNIRDY (SEQ ID NO: 143) | PKTG (SEQ ID NO: 144) | RSDYWDFD (SEQ ID NO: 145) | NGY (SEQ ID NO: 146) | DGS (SEQ ID NO: 147) | YE (SEQ ID NO: 148) |
| GYNIRDY (SEQ ID NO: 143) | PKWG (SEQ ID NO: 169) | RSDYWDFD (SEQ ID NO: 145) | NGY (SEQ ID NO: 146) | DGS (SEQ ID NO: 147) | YE (SEQ ID NO: 148) |
| GYNIRDY (SEQ ID NO: 143) | PKGG (SEQ ID NO: 170) | RSDYWDFD (SEQ ID NO: 145) | NGY (SEQ ID NO: 146) | DGS (SEQ ID NO: 147) | YE (SEQ ID NO: 148) |
| GYNIRDY (SEQ ID NO: 143) | PKAG (SEQ ID NO: 171) | RSDYWDFD (SEQ ID NO: 145) | NGY (SEQ ID NO: 146) | DGS (SEQ ID NO: 147) | YE (SEQ ID NO: 148) |
| GYNIRDY (SEQ ID NO: 143) | PKHG (SEQ ID NO: 172) | RSDYWDFD (SEQ ID NO: 145) | NGY (SEQ ID NO: 146) | DGS (SEQ ID NO: 147) | YE (SEQ ID NO: 148) |
| GYNIRDY (SEQ ID NO: 143) | PKTG (SEQ ID NO: 144) | RTDYWDFD (SEQ ID NO: 173) | NGY (SEQ ID NO: 146) | DGS (SEQ ID NO: 147) | YE (SEQ ID NO: 148) |
| GYNIRDY (SEQ ID NO: 143) | PKTG (SEQ ID NO: 144) | RSDYWDFD (SEQ ID NO: 145) | NGY (SEQ ID NO: 146) | DAS (SEQ ID NO: 174) | YE (SEQ ID NO: 148) |
| GYKIRDY (SEQ ID NO: 459) | PKTG (SEQ ID NO: 144) | RSDYWDFD (SEQ ID NO: 145) | NGY (SEQ ID NO: 146) | DGS (SEQ ID NO: 147) | YE (SEQ ID NO: 148) |
| GYNISDY (SEQ ID NO: 460) | PKTG (SEQ ID NO: 144) | RSDYWDFD (SEQ ID NO: 145) | NGY (SEQ ID NO: 146) | DGS (SEQ ID NO: 147) | YE (SEQ ID NO: 148) |
| GYNIRDH (SEQ ID NO: 461) | PKTG (SEQ ID NO: 144) | RSDYWDFD (SEQ ID NO: 145) | NGY (SEQ ID NO: 146) | DGS (SEQ ID NO: 147) | YE (SEQ ID NO: 148) |
| GYNIRDY (SEQ ID NO: 143) | PKTG (SEQ ID NO: 144) | RSDFWDFD (SEQ ID NO: 156) | NGY (SEQ ID NO: 146) | DGS (SEQ ID NO: 147) | YE (SEQ ID NO: 148) |

TABLE IV

CDR Definitions (IMGT) of Antibodies

| VH-CDR1 | VH-CDR2 | VH-CDR3 | VL-CDR1 | VL-CDR2 | VL-CDR3 |
|---|---|---|---|---|---|
| GYNIRDYF (SEQ ID NO: 149) | INPKTGQP (SEQ ID NO: 150) | ARQRSDYWDFDV (SEQ ID NO: 151) | GY (SEQ ID NO: 152) | DGS (SEQ ID NO: 147) | QVYEF (SEQ ID NO: 142) |
| GYNIRDYF (SEQ ID NO: 149) | INPKWGQP (SEQ ID NO: 175) | ARQRSDYWDFDV (SEQ ID NO: 151) | GY (SEQ ID NO: 152) | DGS (SEQ ID NO: 147) | QVYEF (SEQ ID NO: 142) |
| GYNIRDYF (SEQ ID NO: 149) | INPKGGQP (SEQ ID NO: 176) | ARQRSDYWDFDV (SEQ ID NO: 151) | GY (SEQ ID NO: 152) | DGS (SEQ ID NO: 147) | QVYEF (SEQ ID NO: 142) |
| GYNIRDYF (SEQ ID NO: 149) | INPKAGQP (SEQ ID NO: 177) | ARQRSDYWDFDV (SEQ ID NO: 151) | GY (SEQ ID NO: 152) | DGS (SEQ ID NO: 147) | QVYEF (SEQ ID NO: 142) |
| GYNIRDYF (SEQ ID NO: 149) | INPKHGQP (SEQ ID NO: 178) | ARQRSDYWDFDV (SEQ ID NO: 151) | GY (SEQ ID NO: 152) | DGS (SEQ ID NO: 147) | QVYEF (SEQ ID NO: 142) |

TABLE IV-continued

CDR Definitions (IMGT) of Antibodies

| VH-CDR1 | VH-CDR2 | VH-CDR3 | VL-CDR1 | VL-CDR2 | VL-CDR3 |
|---|---|---|---|---|---|
| GYNIRDYF (SEQ ID NO: 149) | INPKTGQP (SEQ ID NO: 150) | ARQRTDYWDFDV (SEQ ID NO: 179) | GY (SEQ ID NO: 152) | DGS (SEQ ID NO: 147) | QVYEF (SEQ ID NO: 142) |
| GYNIRDYF (SEQ ID NO: 149) | INPKTGQP (SEQ ID NO: 150) | ARQRSDYWDFDV (SEQ ID NO: 151) | GY (SEQ ID NO: 152) | DAS (SEQ ID NO: 180) | QVYEF (SEQ ID NO: 142) |
| GYKIRDYF (SEQ ID NO: 462) | INPKTGQP (SEQ ID NO: 150) | ARQRSDYWDFDV (SEQ ID NO: 151) | GY (SEQ ID NO: 152) | DGS (SEQ ID NO: 147) | QVYEF (SEQ ID NO: 142) |
| GYNISDYF (SEQ ID NO: 463) | INPKTGQP (SEQ ID NO: 150) | ARQRSDYWDFDV (SEQ ID NO: 151) | GY (SEQ ID NO: 152) | DGS (SEQ ID NO: 147) | QVYEF (SEQ ID NO: 142) |
| GYNIRDHF (SEQ ID NO: 464) | INPKTGQP (SEQ ID NO: 150) | ARQRSDYWDFDV (SEQ ID NO: 151) | GY (SEQ ID NO: 152) | DGS (SEQ ID NO: 147) | QVYEF (SEQ ID NO: 142) |
| GYNIRDYF (SEQ ID NO: 149) | INPKTGQP (SEQ ID NO: 150) | ARQRSDFWDFDV (SEQ ID NO: 158) | GY (SEQ ID NO: 152) | DGS (SEQ ID NO: 147) | QVYEF (SEQ ID NO: 142) |

TABLE V

CDR Definitions (Kabat) of Antibodies

| VH-CDR1 | VH-CDR2 | VH-CDR3 | VL-CDR1 | VL-CDR2 | VL-CDR3 |
|---|---|---|---|---|---|
| DYFIH (SEQ ID NO: 137) | WINPKTGQPNNPRQFQG (SEQ ID NO: 138) | QRSDYWDFDV (SEQ ID NO: 139) | QANGYLN (SEQ ID NO: 140) | DGSKLER (SEQ ID NO: 141) | QVYEF (SEQ ID NO: 142) |
| DHFIH (SEQ ID NO: 153) | WINPKTGQPNNPRQFQG (SEQ ID NO: 138) | QRSDYWDFDV (SEQ ID NO: 139) | QANGYLN (SEQ ID NO: 140) | DGSKLER (SEQ ID NO: 141) | QVYEF (SEQ ID NO: 142) |

TABLE VI

CDR Definitions (Chothia) of Antibodies

| VH-CDR1 | VH-CDR2 | VH-CDR3 | VL-CDR1 | VL-CDR2 | VL-CDR3 |
|---|---|---|---|---|---|
| GYNIRDY (SEQ ID NO: 143) | PKTG (SEQ ID NO: 144) | RSDYWDFD (SEQ ID NO: 145) | NGY (SEQ ID NO: 146) | DGS (SEQ ID NO: 147) | YE (SEQ ID NO: 148) |
| GYKIRDH (SEQ ID NO: 457) | PKTG (SEQ ID NO: 144) | RSDYWDFD (SEQ ID NO: 145) | NGY (SEQ ID NO: 146) | DGS (SEQ ID NO: 147) | YE (SEQ ID NO: 148) |

TABLE VII

CDR Definitions (IMGT) of Antibodies

| VH-CDR1 | VH-CDR2 | VH-CDR3 | VL-CDR1 | VL-CDR2 | VL-CDR3 |
|---|---|---|---|---|---|
| GYNIRDYF (SEQ ID NO: 149) | INPKTGQP (SEQ ID NO: 150) | ARQRSDYWDFDV (SEQ ID NO: 151) | GY (SEQ ID NO: 152) | DGS (SEQ ID NO: 147) | QVYEF (SEQ ID NO: 142) |
| GYKIRDHF (SEQ ID NO: 458) | INPKTGQP (SEQ ID NO: 150) | ARQRSDYWDFDV (SEQ ID NO: 151) | GY (SEQ ID NO: 152) | DGS (SEQ ID NO: 147) | QVYEF (SEQ ID NO: 142) |

Encompassed by the present application are anti-gp120 antibodies or gp120-binding fragments thereof that include the six CDRs of each of the antibodies disclosed herein (see, e.g., Tables I-VII). In certain embodiments, one or more of these anti-gp120 antibodies or gp120-binding fragments thereof also include tryptophan (W) or phenylalanine (F) at Kabat position 74a, aspartic acid (D) at Kabat position 74b, phenylalanine (F) at Kabat position 74c, and aspartic acid (D) at Kabat position 74d. It is to be understood that this disclosure also encompasses anti-gp120 antibodies or gp120-binding fragments thereof comprising the CDRs according to any other CDR definition (e.g., Honegger definition, enhanced Chothia definition, AbM definition, contact definition, see, e.g., www.bioinforg.uk/abs/#cdrdef)

of the anti-HIV antibodies disclosed herein. In certain instances, the anti-gp120 antibodies or gp120-binding fragments disclosed herein have improved killing ability of HIV-1 infected target CD4 T cells compared to Antibody A and/or Antibody B. In certain embodiments, antibodies comprising VH and VL comprising the amino acid sequences set forth in SEQ ID NOs.: 477 and 278, respectively, or HC and LC comprising the amino acid sequences set forth in SEQ ID NOs.: 529 and 103, respectively, have improved killing ability of HIV-1 infected target CD4 T cells compared to Antibody A and/or Antibody B. In certain instances, the anti-gp120 antibodies or gp120-binding fragments disclosed herein have an $EC_{50}$ of 0.05 to 2 µg/mL in ADCC assays of NK cell mediated killing of HIV-infected cells (e.g., HIV-1-infected cells). In certain instances, the anti-gp120 antibodies or gp120-binding fragments disclosed herein have an $EC_{50}$ of 0.05 to 1.5 µg/mL. In certain instances, the anti-gp120 antibodies or gp120-binding fragments disclosed herein have an $EC_{50}$ of 0.05 to 1.0 µg/mL. In certain instances, the anti-gp120 antibodies or gp120-binding fragments disclosed herein have an $EC_{50}$ of 0.05 to 0.85 µg/mL. In certain instances, the anti-gp120 antibodies or gp120-binding fragments disclosed herein have an $EC_{50}$ of 0.05 to 0.75 µg/mL. In certain instances, the anti-gp120 antibodies or gp120-binding fragments disclosed herein have an $EC_{50}$ of 0.05 to 0.5 µg/mL. In certain instances, the anti-gp120 antibodies or gp120-binding fragments disclosed herein have an $EC_{50}$ of 0.05 to 0.3 µg/mL. In certain instances, the anti-gp120 antibodies or gp120-binding fragments disclosed herein have an $EC_{50}$ of 0.07 to 0.2 µg/mL.

The amino acid sequences of the heavy chain variable region (VH) of and light chain variable region (VL) of exemplary antibodies of the presentation application are provided in Tables VIII and IX, respectively. The amino acid sequences of the VH and VL of controls used in some assays of this disclosure (e.g., Antibody C and Antibody D) are also included.

TABLE VIII

VH Sequences

| SEQ ID NO | Name | Heavy Chain Variable Region (VH) Amino Acid Sequence |
|---|---|---|
| 181 | C | QVRLSQSGGQMKKPGDSMRISCRASGYEFINCPINWIRLAPGKRPEW MGWMKPRWGAVSYARQLQGRVTMTRDMYSETAFLELRSLTSDDTAVY FCTRGKYCTARDYYNWDFEHWGQGTPVTVSS |
| 182 | A-1 | QVQLLQSGAAVTKPGASVRVSCEASGYNIRDYFIHWWRQAPGQGLQW VGWINPKTGQPNNPRQFQGRVSLTRHASWDFDTFSFYMDLKALRSDD TAVYFCARQRSDYWDFDVWGSGTQVTVSS |
| 183 | D-1 | QVRLSQSGGQMKKPGDSMRISCRASGYEFINCPINWIRLAPGKRPEW MGWMKPRHGAVSYARQLQGRVTMTRDMYSETAFLELRSLTSDDTAVY FCTRGKYCTARDYYNWDFEHWGQGTPVTVSS |
| 184 | 1v2-1 | QVQLLQSGAAVTKPGASVRVSCEASGYNIRDYFIHWWRQAPGQGLQW VGWINPKTGQPNNPRQFQGRVSLTRHASWDFDTYSFYMDLKALRSDD TAVYFCARQRSDYWDFDVWGSGTQVTVSS |
| 185 | 1.2.1-1 | QVQLLQSGAEVKKPGASVRVSCEASGYNIRDYFIHWWRQAPGQGLQW VGWINPKTGQPNNPRQFQGRVSLTRHASWDFDTFSFYMDLKALRSDD TAVYFCARQRSDYWDFDVWGSGTMVTVSS |
| 186 | 1.3.1-1 | QVSLLQSGAAVTKPGASVRVSCEASGYNIRDYFIHWWRQAPGQGLQW VGWINPKTGQPNNPRQFQGRVSLTRHASWDFDTFSFYMDLKALRSDD TAVYFCARQRSDYWDFDVWGSGTQVTVSS |
| 187 | 1.4.1-1 | QVQLVQSGAAVTKPGASVRVSCEASGYNIRDYFIHWWRQAPGQGLQW VGWINPKTGQPNNPRQFQGRVSLTRHASWDFDTFSFYMDLKALRSDD TAVYFCARQRSDYWDFDVWGSGTQVTVSS |
| 188 | 1.5.1-1 | QVQLVQSGAAVTKPGASVRVSCKASGYNIRDYFIHWWRQAPGQGLQW VGWINPKTGQPNNPRQFQGRVSLTRHASWDFDTFSFYMDLKALRSDD TAVYFCARQRSDYWDFDVWGSGTQVTVSS |
| 189 | 1.6.1-1 | QVQLLQSGAEVTKPGASVRVSCEASGYNIRDYFIHWWRQAPGQGLQW VGWINPKTGQPNNPRQFQGRVSLTRHASWDFDTFSFYMDLKALRSDD TAVYFCARQRSDYWDFDVWGSGTQVTVSS |
| 190 | 1.7.1-1 | QVQLLQSGAEVKKPGASVRVSCEASGYNIRDYFIHWWRQAPGQGLQW VGWINPKTGQPNNPRQFQGRVSLTRHASWDFDTFSFYMDLKALRSDD TAVYFCARQRSDYWDFDVWGSGTQVTVSS |
| 191 | 1.8.1-1 | QVQLVQSGAEVTKPGASVRVSCEASGYNIRDYFIHWWRQAPGQGLQW VGWINPKTGQPNNPRQFQGRVSLTRHASWDFDTFSFYMDLKALRSDD TAVYFCARQRSDYWDFDVWGSGTQVTVSS |
| 192 | 1.9.1-1 | QVQLVQSGAEVKKPGASVRVSCKASGYNIRDYFIHWWRQAPGQGLQW VGWINPKTGQPNNPRQFQGRVSLTRHASWDFDTFSFYMDLKALRSDD TAVYFCARQRSDYWDFDVWGSGTQVTVSS |

TABLE VIII-continued

VH Sequences

| SEQ ID NO | Name | Heavy Chain Variable Region (VH) Amino Acid Sequence |
|---|---|---|
| 193 | 1.10.1-1 | QVQLLQSGAAVTKPGASVRVSCEASGYNIRDYFMHWWRQAPGQGLQWVGWINPKTGQPNNPRQFQGRVSLTRHASWDFDTFSFYMDLKALRSDDTAVYFCARQRSDYWDFDVWGSGTQVTVSS |
| 194 | 1.11.1-1 | QVQLLQSGAAVTKPGASVRVSCEASGYNIRDYFMHWWRQAPGQGLQWVGWINPKTGQPNNPRQFQGRVSLTRHASWDFDTFSAYMDLKALRSDDTAVYFCARQRSDYWDFDVWGSGTQVTVSS |
| 195 | 1.15.1-1 | QVQLLQSGAAVTKPGASVRVSCEASGYNIRDYFIHWWRQAPGQGLQWVGWINPKWGQPNNPRQFQGRVSLTRHASWDFDTFSFYMDLKALRSDDTAVYFCARQRSDYWDFDVWGSGTQVTVSS |
| 196 | 1.16.1-1 | QVQLLQSGAAVTKPGASVRVSCEASGYNIRDYFIHWWRQAPGQGLQWVGWINPKGGQPNNPRQFQGRVSLTRHASWDFDTFSFYMDLKALRSDDTAVYFCARQRSDYWDFDVWGSGTQVTVSS |
| 197 | 1.17.1-1 | QVQLLQSGAAVTKPGASVRVSCEASGYNIRDYFIHWWRQAPGQGLQWVGWINPKAGQPNNPRQFQGRVSLTRHASWDFDTFSFYMDLKALRSDDTAVYFCARQRSDYWDFDVWGSGTQVTVSS |
| 198 | 1.18.1-1 | QVQLLQSGAAVTKPGASVRVSCEASGYNIRDYFIHWWRQAPGQGLQWVGWINPKHGQPNNPRQFQGRVSLTRHASWDFDTFSFYMDLKALRSDDTAVYFCARQRSDYWDFDVWGSGTQVTVSS |
| 199 | 1.19.1-1 | QVQLLQSGAAVTKPGASVRVSCEASGYNIRDYFIHWWRQAPGQGLQWVGWINPKTGQPNNPRQFQGRVTLTRHASWDFDTFSFYMDLKALRSDDTAVYFCARQRSDYWDFDVWGSGTQVTVSS |
| 200 | 1.20.1-1 | QVQLLQSGAAVTKPGASVRVSCEASGYNIRDYFIHWWRQAPGQGLQWVGWINPKTGQPNNPRQFQGRVTMTRHASWDFDTFSFYMDLKALRSDDTAVYFCARQRSDYWDFDVWGSGTQVTVSS |
| 201 | 1.21.1-1 | QVQLLQSGAAVTKPGASVRVSCEASGYNIRDYFIHWWRQAPGQGLQWVGWINPKTGQPNNPRQFQGRVSLTRDASWDFDTFSFYMDLKALRSDDTAVYFCARQRSDYWDFDVWGSGTQVTVSS |
| 202 | 1.22.1-1 | QVQLLQSGAAVTKPGASVRVSCEASGYNIRDYFIHWWRQAPGQGLQWVGWINPKTGQPNNPRQFQGRVSLTRHASTFSFYMDLKALRSDDTAVYFCARQRSDYWDFDVWGSGTQVTVSS |
| 203 | 1.24.1-1 | QVQLLQSGAAVTKPGASVRVSCEASGYNIRDYFIHWWRQAPGQGLQWVGWINPKTGQPNNPRQFQGRVSLTRHASWDFDTFSFSMDLKALRSDDTAVYFCARQRSDYWDFDVWGSGTQVTVSS |
| 204 | 1.25.1-1 | QVQLLQSGAAVTKPGASVRVSCEASGYNIRDYFIHWWRQAPGQGLQWVGWINPKTGQPNNPRQFQGRVSLTRHASWDFDTFSFYMDLSRLRSDDTAVYFCARQRSDYWDFDVWGSGTQVTVSS |
| 205 | 1.26.1-1 | QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTATYFCARQRSDYWDFDVWGSGTQVTVSS |
| 206 | 1.27.1-1 | QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRTDYWDFDVWGSGTQVTVSS |
| 207 | 1.28.1-1 | QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTATYFCARQRTDYWDFDVWGSGTQVTVSS |
| 208 | 1.29.1-1 | QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTATYFCARQRTDYWDFDVWGSGTQVTVSS |
| 209 | 1.30.1-1 | QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTMVTVSS |
| 210 | 1.12.15-1 | QVQLLQSGAAVTKPGASVRVSCEASGYNIRDYFIHWVRQAPGQGLQWVGWINPKTGQPNNPRQFQGRVSLTRHASWDFDTFSFYMDLKALRSDDTAVYFCARQRSDYWDFDVWGSGTQVTVSS |

TABLE VIII-continued

VH Sequences

| SEQ ID NO | Name | Heavy Chain Variable Region (VH) Amino Acid Sequence |
|---|---|---|
| 211 | 1.13.15-1 | QVQLLQSGAAVTKPGASVRVSCEASGYNIRDYFMHWVRQAPGQGLQW VGWINPKTGQPNNPRQFQGRVSLTRHASWDFDTFSFYMDLKALRSDD TAVYFCARQRSDYWDFDVWGSGTQVTVSS |
| 212 | 1.14.15-1 | QVQLLQSGAAVTKPGASVRVSCEASGYNIRDYFMHWVRQAPGQGLQW VGWINPKTGQPNNPRQFQGRVSLTRHASWDFDTFSAYMDLKALRSDD TAVYFCARQRSDYWDFDVWGSGTQVTVSS |
| 213 | 1.31.1-1 | QVQLVQSGAEVTKPGASVRVSCEASGYNIRDYFIHWWRQAPGQGLQW VGWINPKTGQPNNPRQFQGRVSLTRHASWDFDTFSFYMDLKALRSDD TATYFCARQRSDYWDFDVWGSGTQVTVSS |
| 214 | 1.32.1-1 | QVQLVQSGAEVTKPGASVRVSCEASGYNIRDYFIHWWRQAPGQGLQW VGWINPKTGQPNNPRQFQGRVSLTRHASWDFDTFSFYMDLKALRSDD TAVYFCARQRTDYWDFDVWGSGTQVTVSS |
| 215 | 1.33.1-1 | QVQLVQSGAEVKKPGASVRVSCKASGYNIRDYFIHWWRQAPGQGLQW VGWINPKTGQPNNPRQFQGRVTLTRHASWDFDTFSFYMDLKALRSDD TATYFCARQRSDYWDFDVWGSGTQVTVSS |
| 216 | 1.34.1-1 | QVQLVQSGAEVKKPGASVRVSCKASGYNIRDYFIHWWRQAPGQGLQW VGWINPKTGQPNNPRQFQGRVTLTRHASWDFDTFSFYMDLKALRSDD TAVYFCARQRTDYWDFDVWGSGTQVTVSS |
| 217 | 1.35.1-1 | QVQLVQSGAEVKKPGASVRVSCKASGYNIRDYFMHWWRQAPGQGLQW VGWINPKTGQPNNPRQFQGRVTMTRHASWDFDTFSFYMDLSRLRSDD TATYFCARQRTDYWDFDVWGQGTMVTVSS |
| 218 | 1.36.1-1 | QVQLVQSGAEVKKPGASVRVSCKASGYNIRDYFMHWWRQAPGQGLQW VGWINPKTGQPNNPRQFQGRVTMTRHASWDFDTFSAYMDLSRLRSDD TATYFCARQRTDYWDFDVWGQGTMVTVSS |
| 219 | 1.37.51-1 | QVQLVQSGAEVKKPGASVRVSCKASGYNIRDYFIHWWRQAPGQGLQW VGWINPKTGQPNNPRQFQGRVSLTRHASWDFDTYSFYMDLSRLRSDD TAVYFCARQRSDYWDFDVWGQGTMVTVSS |
| 220 | B-1 | QVHLSQSGAAVTKPGASVRVSCEASGYKISDHFIHWWRQAPGQGLQW VGWINPKTGQPNNPRQFQGRVSLTRQASWDFDTYSFYMDLKAVRSDD TAIYFCARQRSDFWDFDVWGSGTQVTVSS |
| 221 | 1.41.5-1 | QVQLVQSGAEVKKPGASVRVSCKASGYNIRDYFIHWWRQAPGQGLQW VGWINPKTGQPNNPRQFQGRVSLTRHASWDFDTFSFYMDLKALRSDD TAVYFCARQRSDYWDFDVWGQGTMVTVSS |
| 465 | 2.2.1-1 | QVHLSQSGAAVTKPGASVRVSCEASGYKIRDHFIHWWRQAPGQGLQW VGWINPKTGQPNNPRQFQGRVSLTRHASWDFDTFSFYMDLKAVRSDD TAIYFCARQRSDYWDFDVWGSGTQVTVSS |
| 466 | 2.3.1-1 | QVHLSQSGAAVTKPGASVRVSCEASGYNIRDYFIHWWRQAPGQGLQW VGWINPKTGQPNNPRQFQGRVSLTRHASWDFDTFSFYMDLKAVRSDD TAIYFCARQRSDYWDFDVWGSGTQVTVSS |
| 467 | 1.42.1-1 | QVHLLQSGAAVTKPGASVRVSCEASGYNIRDYFIHWWRQAPGQGLQW VGWINPKTGQPNNPRQFQGRVSLTRHASWDFDTFSFYMDLKALRSDD TAVYFCARQRSDYWDFDVWGSGTQVTVSS |
| 468 | 1.43.1-1 | QVQLSQSGAAVTKPGASVRVSCEASGYNIRDYFIHWWRQAPGQGLQW VGWINPKTGQPNNPRQFQGRVSLTRHASWDFDTFSFYMDLKALRSDD TAVYFCARQRSDYWDFDVWGSGTQVTVSS |
| 469 | 1.44.1-1 | QVQLLQSGAAVTKPGASVRVSCEASGYKIRDYFIHWWRQAPGQGLQW VGWINPKTGQPNNPRQFQGRVSLTRHASWDFDTFSFYMDLKALRSDD TAVYFCARQRSDYWDFDVWGSGTQVTVSS |
| 470 | 1.45.1-1 | QVQLLQSGAAVTKPGASVRVSCEASGYNISDYFIHWWRQAPGQGLQW VGWINPKTGQPNNPRQFQGRVSLTRHASWDFDTFSFYMDLKALRSDD TAVYFCARQRSDYWDFDVWGSGTQVTVSS |
| 471 | 1.46.1-1 | QVQLLQSGAAVTKPGASVRVSCEASGYNIRDHFIHWWRQAPGQGLQW VGWINPKTGQPNNPRQFQGRVSLTRHASWDFDTFSFYMDLKALRSDD TAVYFCARQRSDYWDFDVWGSGTQVTVSS |

TABLE VIII-continued

VH Sequences

| SEQ ID NO | Name | Heavy Chain Variable Region (VH) Amino Acid Sequence |
|---|---|---|
| 472 | 1.47.1-1 | QVQLLQSGAAVTKPGASVRVSCEASGYNIRDYFIHWWRQAPGQGLQWVGWINPKTGQPNNPRQFQGRVSLTRQASWDFDTFSFYMDLKALRSDDTAVYFCARQRSDYWDFDVWGSGTQVTVSS |
| 474 | 1.49.1-1 | QVQLLQSGAAVTKPGASVRVSCEASGYNIRDYFIHWWRQAPGQGLQWVGWINPKTGQPNNPRQFQGRVSLTRHASWDFDTFSFYMDLKAVRSDDTAVYFCARQRSDYWDFDVWGSGTQVTVSS |
| 475 | 1.50.1-1 | QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAIYFCARQRSDYWDFDVWGSGTQVTVSS |
| 476 | 1.51.1-1 | QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDFWDFDVWGSGTQVTVSS |
| 477 | 1.52.64-1 | QVQLLQSGAAVTKPGASVRVSCEASGYNIRDYFIHWWRQAPGQGLQWVGWINPKTGQPNNPRQFQGRVSLTRHASFDFDTFSFYMDLKALRSDDTAVYFCARQRSDYWDFDVWGSGTQVTVSS |
| 478 | 2.4.1-1 | QVHLSQSGAAVTKPGASVRVSCEASGYKIRDHFIHWWRQAPGQGLQWVGWINPKTGQPNNPRQFQGRVSLTRHASFDFDTFSFYMDLKAVRSDDTAIYFCARQRSDYWDFDVWGSGTQVTVSS |

TABLE IX

VL Sequences

| SEQ ID NO | Name | Light Chain Variable Region (VL) Amino Acid Sequence |
|---|---|---|
| 222 | C | EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK |
| 223 | A-1 | DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLK |
| 224 | D-1 | SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK |
| 225 | 1.1.2-1 | DIQMTQSPSSLSASVGDTVTITCQANGYLNWYQQKPGKAPKLLIYDGSKLERGVPSRFSGRRWGQEYNLTINNLQPEDIATYFCQVYEFVVPGTKVDIK |
| 226 | 1.1.3-1 | EIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLK |
| 227 | 1.1.4-1 | DIQMTQSPSSLSASVGDRVTITCQANGYLNWYQQRRGKAPKLLIYDGSKLERGVPSRFSGRRWGQEYNLTINNLQPEDIATYFCQVYEFVVPGTRLDLK |
| 228 | 1.1.5-1 | DIQMTQSPSSLSASVGDTVTITCQANGYLNWYQQKPGKAPKLLIYDGSKLERGVPSRFSGRRWGQEYNLTINNLQPEDIATYFCQVYEFVVPGTRLDLK |
| 229 | 1.1.6-1 | DIQMTQSPSSLSASVGDTVTITCQANGYLNWYQQRRGKAPKLLIYDASKLERGVPSRFSGRRWGQEYNLTINNLQPEDIATYFCQVYEFVVPGTRLDLK |
| 230 | 1.1.7-1 | DIQMTQSPSSLSASVGDTVTITCQANGYLNWYQQRRGKAPKLLIYDGSNLERGVPSRFSGRRWGQEYNLTINNLQPEDIATYFCQVYEFVVPGTRLDLK |

TABLE IX-continued

VL Sequences

| SEQ ID NO | Name | Light Chain Variable Region (VL) Amino Acid Sequence |
|---|---|---|
| 231 | 1.1.8-1 | DIQMTQSPSSLSASVGDTVTITCQANGYLNWYQQRRGKAPKL<br>LIYDASNLERGVPSRFSGRRWGQEYNLTINNLQPEDIATYFC<br>QVYEFVVPGTRLDLK |
| 232 | 1.1.9-1 | DIQMTQSPSSLSASVGDTVTITCQANGYLNWYQQRRGKAPKL<br>LIYDGSKLETGVPSRFSGRRWGQEYNLTINNLQPEDIATYFC<br>QVYEFVVPGTRLDLK |
| 233 | 1.1.10-1 | DIQMTQSPSSLSASVGDTVTITCQANGYLNWYQQRRGKAPKL<br>LIYDGSKLERGVPSRFSGRRWGQEYTLTINNLQPEDIATYFC<br>QVYEFVVPGTRLDLK |
| 234 | 1.1.11-1 | DIQMTQSPSSLSASVGDTVTITCQANGYLNWYQQRRGKAPKL<br>LIYDGSKLERGVPSRFSGSRWGQEYTLTINNLQPEDIATYFC<br>QVYEFVVPGTRLDLK |
| 235 | 1.1.12-1 | DIQMTQSPSSLSASVGDTVTITCQANGYLNWYQQRRGKAPKL<br>LIYDGSKLERGVPSRFSGRRWGQEYNLTISSLQPEDIATYFC<br>QVYEFVVPGTRLDLK |
| 236 | 1.1.13-1 | DIQMTQSPSSLSASVGDTVTITCQANGYLNWYQQRRGKAPKL<br>LIYDGSKLERGVPSRFSGSRWGQEYTLTISSLQPEDIATYFC<br>QVYEFVVPGTRLDLK |
| 237 | 1.1.14-1 | DIQMTQSPSSLSASVGDTVTITCQANGYLNWYQQRRGKAPKL<br>LIYDGSKLERGVPSRFSGSGSGTDFTFTINNLQPEDIATYFC<br>QVYEFVVPGTRLDLK |
| 238 | 1.1.15-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFFVPGTRLDLK |
| 239 | 1.1.16-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVGPGTRLDLK |
| 240 | 1.1.17-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFFGPGTRLDLK |
| 241 | 1.1.18-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVSPGTRLDLK |
| 242 | 1.1.19-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVTPGTRLDLK |
| 243 | 1.1.20-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVVPGTNLDLK |
| 244 | 1.1.21-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVGPGTNLDLK |
| 245 | 1.1.22-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVSPGTNLDLK |
| 246 | 1.1.23-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVTPGTNLDLK |
| 247 | 1.1.24-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVVPGTRVDLK |
| 248 | 1.1.25-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVVPGTNVDLK |

TABLE IX-continued

VL Sequences

| SEQ ID NO | Name | Light Chain Variable Region (VL) Amino Acid Sequence |
|---|---|---|
| 249 | 1.1.26-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVVPGTRLDIK |
| 250 | 1.1.27-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVVPGTRVDIK |
| 251 | 1.1.28-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVVPGTNVDIK |
| 252 | 1.1.29-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVGPGTNVDIK |
| 253 | 1.1.30-1 | DIQMTQSPSSLSASVGDTVTITCQANGYLNWYQQRRGKAPKL<br>LIYDGSKLERGVPSRFSGRRWGQEYNLTINNLQPEDIATYFC<br>QVYEFVTPGTNVDIK |
| 254 | 1.1.31-1 | DIQMTQSPSSLSASVGDTVTITCQANGYLNWYQQRRGKAPKL<br>LIYDGSKLERGVPSRFSGRRWGQEYTLTISSLQPEDIATYFC<br>QVYEFVVPGTNLDLK |
| 255 | 1.1.32-1 | DIQMTQSPSSLSASVGDTVTITCQANGYLNWYQQRRGKAPKL<br>LIYDGSKLERGVPSRFSGRRWGQEYTLTISSLQPEDIATYFC<br>QVYEFVTPGTRLDLK |
| 256 | 1.1.33-1 | DIQMTQSPSSLSASVGDTVTITCQANGYLNWYQQRRGKAPKL<br>LIYDGSNLERGVPSRFSGRRWGQEYTLTISSLQPEDIATYFC<br>QVYEFVVPGTNLDIK |
| 257 | 1.1.34-1 | DIQMTQSPSSLSASVGDTVTITCQANGYLNWYQQRRGKAPKL<br>LIYDGSNLERGVPSRFSGRRWGQEYTLTISSLQPEDIATYFC<br>QVYEFVTPGTRLDIK |
| 258 | 1.1.35-1 | DIQMTQSPSSLSASVGDRVTITCQANGYLNWYQQKPGKAPKL<br>LIYDGSNLETGVPSRFSGSRWGQEYTLTISSLQPEDIATYFC<br>QVYEFVGPGTNLDIK |
| 259 | 1.1.36-1 | DIQMTQSPSSLSASVGDRVTITCQANGYLNWYQQKPGKAPKL<br>LIYDGSNLETGVPSRFSGSRWGQEYTLTISSLQPEDIATYFC<br>QVYEFVTPGTNLDIK |
| 260 | 1.1.37-1 | DIQMTQSPSSLSASVGDTVTITCQANGYLNWYQQRRGKAPKL<br>LIYDGSKLERGVPSRFSGRRWGQEYTFTINNLQPEDIATYFC<br>QVYEFVVPGTRLDLK |
| 261 | 1.1.38-1 | DIQMTQSPSSLSASVGDTVTITCQANGYLNWYQQRRGKAPKL<br>LIYDGSKLERGVPSRFSGRRWGQEYSLTINNLQPEDIATYFC<br>QVYEFVVPGTRLDLK |
| 262 | 1.1.39-1 | DIQMTQSPSSLSASVGDTVTITCQANGYLNWYQQRRGKAPKL<br>LIYDGSKLERGVPSRFSGRRWGQEYSFTINNLQPEDIATYFC<br>QVYEFVVPGTRLDLK |
| 263 | 1.1.40-1 | DIQMTQSPSSLSASVGDTVTITCQANGYLNWYQQRRGKAPKL<br>LIYDGSKLERGVPSRFSGRRWGQEYALTINNLQPEDIATYFC<br>QVYEFVVPGTRLDLK |
| 264 | 1.1.41-1 | DIQMTQSPSSLSASVGDTVTITCQANGYLNWYQQRRGKAPKL<br>LIYDGSKLERGVPSRFSGRRWGQEYAFTINNLQPEDIATYFC<br>QVYEFVVPGTRLDLK |
| 265 | 1.1.42-1 | DIQMTQSPSSLSASVGDTVTITCQANGYLNWYQQRRGKAPKL<br>LIYDGSKLERGVPSRFSGRRWGQEYHLTINNLQPEDIATYFC<br>QVYEFVVPGTRLDLKR |
| 266 | 1.1.43-1 | DIQMTQSPSSLSASVGDTVTITCQANGYLNWYQQRRGKAPKL<br>LIYDGSKLERGVPSRFSGRRWGQEYHFTINNLQPEDIATYFC<br>QVYEFVVPGTRLDLK |

TABLE IX-continued

VL Sequences

| SEQ ID NO | Name | Light Chain Variable Region (VL) Amino Acid Sequence |
|---|---|---|
| 267 | 1.1.44-1 | DIQMTQSPSSLSASVGDTVTITCQANGYLNWYQQRRGKAPKL LIYDGSKLERGVPSRFSGRRWGQEYQLTINNLQPEDIATYFC QVYEFVVPGTRLDLK |
| 268 | 1.1.45-1 | DIQMTQSPSSLSASVGDTVTITCQANGYLNWYQQRRGKAPKL LIYDGSKLERGVPSRFSGRRWGQEYQFTINNLQPEDIATYFC QVYEFVVPGTRLDLK |
| 269 | 1.1.46-1 | DIQMTQSPSSLSASVGDTVTITCQANGYLNWYQQRRGKAPKL LIYDGSKLERGVPSRFSGRRWGQEYNLKINNLQPEDIATYFC QVYEFVVPGTRLDLK |
| 270 | 1.1.47-1 | DIQMTQSPSSLSASVGDTVTITCQANGYLNWYQQRRGKAPKL LIYDGSKLERGVPSRFSGRRWGQEYNFKINNLQPEDIATYFC QVYEFVVPGTRLDLK |
| 271 | 1.1.48-1 | DIQMTQSPSSLSASVGDTVTITCQANGYLNWYQQRRGKAPKL LIYDGSKLERGVPSRFSGRRWGQEYNLAINNLQPEDIATYFC QVYEFVVPGTRLDLK |
| 272 | 1.1.49-1 | DIQMTQSPSSLSASVGDTVTITCQANGYLNWYQQRRGKAPKL LIYDGSKLERGVPSRFSGRRWGQEYNFAINNLQPEDIATYFC QVYEFVVPGTRLDLK |
| 273 | 1.37.51-1 | DIQMTQSPSSLSASVGDRVTITCQANGYLNWYQQKPGKAPKL LIYDGSKLETGVPSRFSGSRWGQEYTLTINNLQPEDIATYFC QVYEFFGPGTRLDLK |
| 274 | 1.8.52-1 | DIQMTQSPSSLSASVGDRVTITCQANGYLNWYQQKPGKAPKL LIYDGSKLERGVPSRFSGRRWGQEYTLTINNLQPEDIATYFC QVYEFVVPGTRLDLK |
| 275 | 1.1.54-1 | DIQMTQSPSSLSASVGDTATITCQANGYLNWYQQRRGKAPKL LIYDGSKLERGVPSRFSGRRWGQEYTLTINNLQPEDIATYFC QVYEFVVPGTRLDLK |
| 276 | B-1 | DIQMTQSPSSLSARVGDTVTITCQANGYLNWYQQRRGKAPKL LIYDGSKLERGVPARFSGRRWGQEYNLTINNLQPEDVATYFC QVYEFIVPGTRLDLK |
| 277 | 2.1.2-1 | DIQMTQSPSSLSARVGDTVTITCQANGYLNWYQQRRGKAPKL LIYDGSKLERGVPARFSGRRWGQEYHLTINNLQPEDVATYFC QVYEFIVPGTRLDLK |
| 278 | 1.1.64-1 | DIQMTQSPSSLSASVGDTATITCQANGYLNWYQQRRGKAPKL LIYDGSKLERGVPSRFSGRRWGQEYNLTINNLQPEDIATYFC QVYEFVVPGTRLDLK |
| 279 | 1.1.67-1 | DIQMTQSPSSLSASVGDTATITCQANGYLNWYQQRRGKAPKL LIYDGSKLERGVPSRFSGRRWGQEYNLTINNLQPEDIATYFC QVYEFFGPGTRLDLK |
| 280 | 1.1.72-1 | DIQMTQSPSSLSASVGDTVTITCQANGYLNWYQQRRGKAPKL LIYDGSKLERGVPSRFSGRRWGQEYHLTINNLQPEDIATYFC QVYEFFGPGTRLDLK |
| 281 | 1.1.75-1 | DIQMTQSPSSLSASVGDTATITCQANGYLNWYQQRRGKAPKL LIYDGSKLERGVPSRFSGRRWGQEYHLTINNLQPEDIATYFC QVYEFVVPGTRLDLK |
| 282 | 1.1.78-1 | DIQMTQSPSSLSASVGDTATITCQANGYLNWYQQRRGKAPKL LIYDGSKLERGVPSRFSGRRWGQEYHLTINNLQPEDIATYFC QVYEFFGPGTRLDLK |
| 283 | 1.41.81-1 | DIQMTQSPSSLSASVGDTVTITCQANGYLNWYQQKPGKAPKL LIYDGSKLERGVPSRFSGRRWGQEYNLTINNLQPEDIATYFC QVYEFFGPGTRLDLK |
| 284 | 1.1.82-1 | DIQMTQSPSSLSASVGDRVTITCQANGYLNWYQQRRGKAPKL LIYDGSKLERGVPSRFSGSRWGQEYNLTISSLQPEDIATYFC QVYEFVVPGTRLDLK |

TABLE IX-continued

VL Sequences

| SEQ ID NO | Name | Light Chain Variable Region (VL) Amino Acid Sequence |
|---|---|---|
| 285 | 1.41.83-1 | DIQMTQSPSSLSASVGDRVTITCQANGYLNWYQQKPGKAPKLLIYDGSKLERGVPSRFSGSRWGQEYNLTISSLQPEDIATYFCQVYEFVVPGTRLDLK |
| 286 | 1.1.84-1 | DIQMTQSPSSLSASVGDRVTITCQANGYLNWYQQRRGKAPKLLIYDGSKLERGVPSRFSGSRWGQEYNLTISSLQPEDIATYFCQVYEFFGPGTRLDLK |
| 287 | 1.41.85-1 | DIQMTQSPSSLSASVGDRVTITCQANGYLNWYQQKPGKAPKLLIYDGSKLERGVPSRFSGSRWGQEYNLTISSLQPEDIATYFCQVYEFFGPGTRLDLK |
| 288 | 1.41.86-1 | DIQMTQSPSSLSASVGDTATITCQANGYLNWYQQKPGKAPKLLIYDGSKLERGVPSRFSGRRWGQEYNLTINNLQPEDIATYFCQVYEFVVPGTRLDLK |
| 289 | 1.41.87-1 | DIQMTQSPSSLSASVGDTATITCQANGYLNWYQQKPGKAPKLLIYDGSKLERGVPSRFSGRRWGQEYNLTINNLQPEDIATYFCQVYEFFGPGTRLDLK |
| 290 | 1.1.88-1 | DIQMTQSPSSLSASVGDRATITCQANGYLNWYQQRRGKAPKLLIYDGSKLERGVPSRFSGSRWGQEYNLTISSLQPEDIATYFCQVYEFVVPGTRLDLK |
| 291 | 1.41.89-1 | DIQMTQSPSSLSASVGDRATITCQANGYLNWYQQKPGKAPKLLIYDGSKLERGVPSRFSGSRWGQEYNLTISSLQPEDIATYFCQVYEFVVPGTRLDLK |
| 292 | 1.1.90-1 | DIQMTQSPSSLSASVGDRATITCQANGYLNWYQQRRGKAPKLLIYDGSKLERGVPSRFSGSRWGQEYNLTISSLQPEDIATYFCQVYEFFGPGTRLDLK |
| 293 | 1.41.91-1 | DIQMTQSPSSLSASVGDRATITCQANGYLNWYQQKPGKAPKLLIYDGSKLERGVPSRFSGSRWGQEYNLTISSLQPEDIATYFCQVYEFFGPGTRLDLK |
| 294 | 1.41.92-1 | DIQMTQSPSSLSASVGDTVTITCQANGYLNWYQQKPGKAPKLLIYDGSKLERGVPSRFSGRRWGQEYHLTINNLQPEDIATYFCQVYEFVVPGTRLDLK |
| 295 | 1.41.93-1 | DIQMTQSPSSLSASVGDTVTITCQANGYLNWYQQKPGKAPKLLIYDGSKLERGVPSRFSGRRWGQEYHLTINNLQPEDIATYFCQVYEFFGPGTRLDLK |
| 296 | 1.1.94-1 | DIQMTQSPSSLSASVGDRVTITCQANGYLNWYQQRRGKAPKLLIYDGSKLERGVPSRFSGSRWGQEYHLTISSLQPEDIATYFCQVYEFVVPGTRLDLK |
| 297 | 1.41.95-1 | DIQMTQSPSSLSASVGDRVTITCQANGYLNWYQQKPGKAPKLLIYDGSKLERGVPSRFSGSRWGQEYHLTISSLQPEDIATYFCQVYEFVVPGTRLDLK |
| 298 | 1.1.96-1 | DIQMTQSPSSLSASVGDRVTITCQANGYLNWYQQRRGKAPKLLIYDGSKLERGVPSRFSGSRWGQEYHLTISSLQPEDIATYFCQVYEFFGPGTRLDLK |
| 299 | 1.41.97-1 | DIQMTQSPSSLSASVGDRVTITCQANGYLNWYQQKPGKAPKLLIYDGSKLERGVPSRFSGSRWGQEYHLTISSLQPEDIATYFCQVYEFFGPGTRLDLK |
| 300 | 1.41.98-1 | DIQMTQSPSSLSASVGDTATITCQANGYLNWYQQKPGKAPKLLIYDGSKLERGVPSRFSGRRWGQEYHLTINNLQPEDIATYFCQVYEFVVPGTRLDLK |
| 301 | 1.41.99-1 | DIQMTQSPSSLSASVGDTATITCQANGYLNWYQQKPGKAPKLLIYDGSKLERGVPSRFSGRRWGQEYHLTINNLQPEDIATYFCQVYEFFGPGTRLDLK |
| 302 | 1.1.100-1 | DIQMTQSPSSLSASVGDRATITCQANGYLNWYQQRRGKAPKLLIYDGSKLERGVPSRFSGSRWGQEYHLTISSLQPEDIATYFCQVYEFVVPGTRLDLK |

TABLE IX-continued

VL Sequences

| SEQ ID NO | Name | Light Chain Variable Region (VL) Amino Acid Sequence |
|---|---|---|
| 303 | 1.41.101-1 | DIQMTQSPSSLSASVGDRATITCQANGYLNWYQQKPGKAPKL LIYDGSKLERGVPSRFSGSRWGQEYHLTISSLQPEDIATYFC QVYEFVVPGTRLDLK |
| 304 | 1.1.102-1 | DIQMTQSPSSLSASVGDRATITCQANGYLNWYQQRRGKAPKL LIYDGSKLERGVPSRFSGSRWGQEYHLTISSLQPEDIATYFC QVYEFFGPGTRLDLK |
| 305 | 1.41.103-1 | DIQMTQSPSSLSASVGDRATITCQANGYLNWYQQKPGKAPKL LIYDGSKLERGVPSRFSGSRWGQEYHLTISSLQPEDIATYFC QVYEFFGPGTRLDLK |
| 306 | 1.1.110-1 | DIQMTQSPSSLSASVGDTVTITCQANGYLNWYQQRRGKAPKL LIYDGSKLERGVPSRFSGTRRGQDYIFSINNLQPEDIATYFC QVYEFVVPGTRLDLK |
| 307 | 1.1.111-1 | DIQMTQSPSSLSASVGDTVTITCQANGYLNWYQQRRGKAPKL LIYDGSKLERGVPSRFSGRRFGQDYILTINNLQPEDIATYFC QVYEFVVPGTRLDLK |
| 308 | 1.1.112-1 | DIQMTQSPSSLSASVGDTVTITCQANGYLNWYQQRRGKAPKL LIYDGSKLERGVPSRFSGSRFGQKYQLSINNLQPEDIATYFC QVYEFVVPGTRLDLK |
| 309 | 1.1.113-1 | DIQMTQSPSSLSASVGDTATITCQANGYLNWYQQRRGKAPKL LIYDGSKLERGVPSRFSGRRFGQDYILTINNLQPEDIATYFC QVYEFVVPGTRLDLK |
| 310 | 2.1.3-1 | DIQMTQSPSSLSARVGDTVTITCQANGYLNWYQQRRGKAPKL LIYDGSKLERGVPARFSGRRFGQDYILTINNLQPEDVATYFC QVYEFIVPGTRLDLK |
| 311 | 2.1.4-1 | DIQMTQSPSSLSARVGDTATITCQANGYLNWYQQRRGKAPKL LIYDGSKLERGVPARFSGRRFGQDYILTINNLQPEDVATYFC QVYEFIVPGTRLDLK |
| 479 | 3.1.8-1 | DIQMTQSPSSLSARVGDTATITCQANGYLNWYQQRRGKAPKL LIYDGSKLERGVPARFSGRRWGQEYNLTINNLQPEDVATYFC QVYEFIVPGTRLDLK |
| 480 | 3.1.9-1 | DIQMTQSPSSLSARVGDTATITCQANGYLNWYQQRRGKAPKL LIYDGSKLERGVPARFSGRRWGQEYNLTINNLQPEDVATYFC QVYEFFGPGTRLDLK |
| 481 | 1.1.115-1 | DIQMTQSPSSLSASVGDTVTITCQANGYLNWYQQRRGKAPKL LIYDGSKLERGVPSRFSGRRWGQEYILTINNLQPEDIATYFC QVYEFVVPGTRLDLK |
| 482 | 3.1.10-1 | DIQMTQSPSSLSARVGDTVTITCQANGYLNWYQQRRGKAPKL LIYDGSKLERGVPARFSGRRWGQEYILTINNLQPEDVATYFC QVYEFIVPGTRLDLK |
| 483 | 1.1.116-1 | DIQMTQSPSSLSASVGDTATITCQANGYLNWYQQRRGKAPKL LIYDGSKLERGVPSRFSGRRWGQEYILTINNLQPEDIATYFC QVYEFVVPGTRLDLK |
| 484 | 3.1.11-1 | DIQMTQSPSSLSARVGDTATITCQANGYLNWYQQRRGKAPKL LIYDGSKLERGVPARFSGRRWGQEYILTINNLQPEDVATYFC QVYEFIVPGTRLDLK |
| 485 | 1.1.117-1 | DIQMTQSPSSLSASVGDTATITCQANGYLNWYQQRRGKAPKL LIYDGSKLERGVPSRFSGRRWGQEYILTINNLQPEDIATYFC QVYEFFGPGTRLDLK |
| 486 | 3.1.12-1 | DIQMTQSPSSLSARVGDTATITCQANGYLNWYQQRRGKAPKL LIYDGSKLERGVPARFSGRRWGQEYILTINNLQPEDVATYFC QVYEFFGPGTRLDLK |
| 487 | 1.1.118-1 | DIQMTQSPSSLSASVGDRATITCQANGYLNWYQQRRGKAPKL LIYDGSKLERGVPSRFSGSRWGQEYILTISSLQPEDIATYFC QVYEFFGPGTRLDLK |

TABLE IX-continued

VL Sequences

| SEQ ID NO | Name | Light Chain Variable Region (VL) Amino Acid Sequence |
|---|---|---|
| 488 | 3.1.13-1 | DIQMTQSPSSLSARVGDRATITCQANGYLNWYQQRRGKAPKL<br>LIYDGSKLERGVPARFSGSRWGQEYILTISSLQPEDVATYFC<br>QVYEFFGPGTRLDLK |
| 489 | 3.1.14-1 | DIQMTQSPSSLSARVGDTVTITCQANGYLNWYQQRRGKAPKL<br>LIYDGSKLERGVPARFSGRRWGQEYTLTINNLQPEDVATYFC<br>QVYEFIVPGTRLDLK |
| 491 | 3.1.5-1 | DIQMTQSPSSLSARVGDTATITCQANGYLNWYQQRRGKAPKL<br>LIYDGSKLERGVPARFSGRRWGQEYTLTINNLQPEDVATYFC<br>QVYEFIVPGTRLDLK |
| 492 | 3.1.15-1 | DIQMTQSPSSLSARVGDTATITCQANGYLNWYQQRRGKAPKL<br>LIYDGSKLERGVPARFSGRRWGQEYTLTINNLQPEDVATYFC<br>QVYEFFGPGTRLDLK |
| 493 | 1.1.119-1 | DIQMTQSPSSLSASVGDRATITCQANGYLNWYQQRRGKAPKL<br>LIYDGSKLERGVPSRFSGSRWGQEYTLTISSLQPEDIATYFC<br>QVYEFFGPGTRLDLK |
| 494 | 3.1.7-1 | DIQMTQSPSSLSARVGDRATITCQANGYLNWYQQRRGKAPKL<br>LIYDGSKLERGVPARFSGSRWGQEYTLTISSLQPEDVATYFC<br>QVYEFFGPGTRLDLK |
| 495 | 3.1.16-1 | DIQMTQSPSSLSARVGDTATITCQANGYLNWYQQRRGKAPKL<br>LIYDGSKLERGVPARFSGRRWGQEYHLTINNLQPEDVATYFC<br>QVYEFIVPGTRLDLK |
| 496 | 3.1.17-1 | DIQMTQSPSSLSARVGDTATITCQANGYLNWYQQRRGKAPKL<br>LIYDGSKLERGVPARFSGRRWGQEYHLTINNLQPEDVATYFC<br>QVYEFFGPGTRLDLK |
| 497 | 3.1.18-1 | DIQMTQSPSSLSARVGDRATITCQANGYLNWYQQRRGKAPKL<br>LIYDGSKLERGVPARFSGSRWGQEYHLTISSLQPEDVATYFC<br>QVYEFFGPGTRLDLK |
| 498 | 1.1.120-1 | DIQMTQSPSSLSASVGDTATITCQANGYLNWYQQRRGKAPKL<br>LIYDGSKLERGVPSRFSGRRWGQDYILTINNLQPEDIATYFC<br>QVYEFVVPGTRLDLK |
| 499 | 3.1.19-1 | DIQMTQSPSSLSARVGDTATITCQANGYLNWYQQRRGKAPKL<br>LIYDGSKLERGVPARFSGRRWGQDYILTINNLQPEDVATYFC<br>QVYEFIVPGTRLDLK |
| 500 | 1.1.121-1 | DIQMTQSPSSLSASVGDTATITCQANGYLNWYQQRRGKAPKL<br>LIYDGSKLERGVPSRFSGRRFGQEYILTINNLQPEDIATYFC<br>QVYEFVVPGTRLDLK |
| 501 | 3.1.20-1 | DIQMTQSPSSLSARVGDTATITCQANGYLNWYQQRRGKAPKL<br>LIYDGSKLERGVPARFSGRRFGQEYILTINNLQPEDVATYFC<br>QVYEFIVPGTRLDLK |
| 502 | 1.1.122-1 | DIQMTQSPSSLSASVGDTATITCQANGYLNWYQQRRGKAPKL<br>LIYDGSKLERGVPSRFSGRRWGQEYVLTINNLQPEDIATYFC<br>QVYEFVVPGTRLDLK |
| 503 | 1.1.123-1 | DIQMTQSPSSLSASVGDTATITCQANGYLNWYQQRRGKAPKL<br>LIYDGSKLERGVPSRFSGRRWGQEYLLTINNLQPEDIATYFC<br>QVYEFVVPGTRLDLK |
| 504 | 1.1.124-1 | DIQMTQSPSSLSASVGDTATITCQANGYLNWYQQRRGKAPKL<br>LIYDGSKLERGVPSRFSGRRWGQEYMLTINNLQPEDIATYFC<br>QVYEFVVPGTRLDLK |
| 505 | 1.1.125-1 | DIQMTQSPSSLSASVGDTATITCQANGYLNWYQQRRGKAPKL<br>LIYDGSKLERGVPSRFSGRRWGQEYALTINNLQPEDIATYFC<br>QVYEFVVPGTRLDLK |
| 506 | 1.1.126-1 | DIQMTQSPSSLSASVGDTATITCQANGYLNWYQQRRGKAPKL<br>LIYDGSKLERGVPSRFSGRRWGQEYSLTINNLQPEDIATYFC<br>QVYEFVVPGTRLDLK |

TABLE IX-continued

VL Sequences

| SEQ ID NO | Name | Light Chain Variable Region (VL) Amino Acid Sequence |
|---|---|---|
| 507 | 1.1.127-1 | DIQMTQSPSSLSASVGDTATITCQANGYLNWYQQRRGKAPKL LIYDGSKLERGVPSRFSGRRWGQEYFLTINNLQPEDIATYFC QVYEFVVPGTRLDLK |
| 508 | 1.1.128-1 | DIQMTQSPSSLSASVGDTATITCQANGYLNWYQQRRGKAPKL LIYDGSKLERGVPSRFSGTRWGQEYILTINNLQPEDIATYFC QVYEFVVPGTRLDLK |
| 509 | 1.1.129-1 | DIQMTQSPSSLSASVGDTATITCQANGYLNWYQQRRGKAPKL LIYDGSKLERGVPSRFSGRRRGQEYILTINNLQPEDIATYFC QVYEFVVPGTRLDLK |
| 510 | 1.1.130-1 | DIQMTQSPSSLSASVGDTATITCQANGYLNWYQQRRGKAPKL LIYDGSKLERGVPSRFSGRRYGQEYILTINNLQPEDIATYFC QVYEFVVPGTRLDLK |
| 511 | 1.1.131-1 | DIQMTQSPSSLSASVGDTATITCQANGYLNWYQQRRGKAPKL LIYDGSKLERGVPSRFSGTRWGQDYILTINNLQPEDIATYFC QVYEFVVPGTRLDLK |
| 512 | 1.1.132-1 | DIQMTQSPSSLSARVGDTVTITCQANGYLNWYQQRRGKAPKL LIYDGSKLERGVPSRFSGRRWGQEYNLTINNLQPEDIATYFC QVYEFVVPGTRLDLK |
| 513 | 1.1.133-1 | DIQMTQSPSSLSASVGDTVTITCQANGYLNWYQQRRGKAPKL LIYDGSKLERGVPARFSGRRWGQEYNLTINNLQPEDIATYFC QVYEFVVPGTRLDLK |
| 514 | 1.1.134-1 | DIQMTQSPSSLSASVGDTVTITCQANGYLNWYQQRRGKAPKL LIYDGSKLERGVPSRFSGRRWGQEYNLTINNLQPEDVATYFC QVYEFVVPGTRLDLK |
| 515 | 1.1.135-1 | DIQMTQSPSSLSASVGDTVTITCQANGYLNWYQQRRGKAPKL LIYDGSKLERGVPSRFSGRRWGQEYNLTINNLQPEDIATYFC QVYEFIVPGTRLDLK |
| 569 | 1.1.138-1 | DIQMTQSPSSLSASVGDTVTITCQATGYLNWYQQRRGKAPKL LIYDGSKLERGVPSRFSGRRWGQEYNLTINNLQPEDIATYFC QVYEFVVPGTRLDLK |
| 516 | 1.1.104-1 | DIQMTQSPSSLSASVGDTATITCQANGYLNWYQQRRGKAPKL LIYDGSKLERGVPSRFSGRRWGQEYTLTINNLQPEDIATYFC QVYEFFGPGTRLDLK |

In some embodiments, the anti-gp120 antibodies or gp120-binding fragments described herein have a VH that is at least 80%, at least 85%, at least 90%, at least 91%, at least 92%, at least 93%, at least 94%, at least 95%, at least 96%, at least 97%, at least 98%, at least 99%, or 100%, identical to an amino acid sequence selected from the group consisting of SEQ ID NOs: 181-221 and 465-478 and a VL that is at least 80%, at least 85%, at least 90%, at least 91%, at least 92%, at least 93%, at least 94%, at least 95%, at least 96%, at least 97%, at least 98%, at least 99%, or 100%, identical to an amino acid sequence selected from the group consisting of SEQ ID NOs: 222-311, 479-516 and 569. In some embodiments, the anti-gp120 antibodies or gp120-binding fragments described herein have a VH selected from the group consisting of SEQ ID NOs: 181-221 and 465-478, and a VL selected from the group consisting of SEQ ID NOs: 222-311, 479-516 and 569.

When comparing polynucleotide and polypeptide sequences, two sequences are said to be "identical" if the sequence of nucleotides or amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J. (1990) Unified Approach to Alignment and Phylogenes pp. 626-645 Methods in Enzymology vol. 183, Academic Press, Inc., San Diego, Calif.; Higgins, D. G. and Sharp, P. M. (1989) CABIOS 5: 151-153; Myers, E. W. and Muller W. (1988)

CABIOS 4:11-17; Robinson, E. D. (1971) Comb. Theor 77: 105; Santou, N. Nes, M. (1987) Mol. Biol. Evol. 4:406-425; Sneath, P. H. A. and Sokal, R. R. (1973) Numerical Taxonomy—the Principles and Practice of Numerical Taxonomy, Freeman Press, San Francisco, Calif.; Wilbur, W. J. and Lipman, D. J. (1983) Proc. Natl. Acad., Sci. USA 80:726-730.

Alternatively, alignment of sequences for comparison may be conducted by the local identity algorithm of Smith and Waterman (1981) Add. APL. Math 2:482, by the identity alignment algorithm of Needleman and Wunsch (1970) J. Mol. Biol. 48:443, by the search for similarity methods of Pearson and Lipman (1988) Proc. Natl. Acad. Sci. USA 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One example of algorithms that are suitable for determining percent sequence identity and sequence similarity are the BLAST and BLAST 2.0 algorithms, which are described in Altschul et al. (1977) Nucl. Acids Res. 25:3389-3402 and Altschul et al. (1990) J. Mol. Biol. 215:403-410, respectively. BLAST and BLAST 2.0 can be used, for example with the parameters described herein, to determine percent sequence identity for the polynucleotides and polypeptides described herein. Software for performing BLAST analyses is publicly available through the National Center for Biotechnology Information.

In one illustrative example, cumulative scores can be calculated using, for nucleotide sequences, the parameters M (reward score for a pair of matching residues; always >0) and N (penalty score for mismatching residues; always <0). Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a word length (W) of 11, and expectation (E) of 10, and the BLOSUM62 scoring matrix (see Henikoff and Henikoff (1989) Proc. Natl. Acad. Sci. USA 89: 10915) alignments, (B) of 50, expectation (E) of 10, M=5, N=-4 and a comparison of both strands.

For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment.

In one approach, the "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for alignment of the two sequences. The percentage is calculated by determining the number of positions at which the identical nucleic acid bases or amino acid residues occur in both sequences to yield the number of matched positions, dividing the number of matched positions by the total number of positions in the reference sequence (i.e., the window size) and multiplying the results by 100 to yield the percentage of sequence identity.

Encompassed by this disclosure are anti-gp120 antibodies or gp120-binding fragments thereof that include the VH of any of antibodies disclosed herein. In certain embodiments, the anti-gp120 antibody or gp120-binding fragment thereof includes the VH of any one of Antibody A-1, Antibody 1.1.64-1, Antibody 1.90-1, Antibody 2.2.1-1, Antibody 2.3.1-1, Antibody 3.1.5-1, Antibody 2.2.5-1, Antibody 2.3.5-1, Antibody 1.1.119-1, Antibody 1.1.104-1, Antibody 1.52.64-1, Antibody 2.4.1-1, Antibody 1.1.54-1, or Antibody 2-1. In certain embodiments, the anti-gp120 antibody or gp120-binding fragment thereof includes the VH of Antibody 1.52.64-1.

Encompassed by this disclosure are anti-gp120 antibodies or gp120-binding fragments thereof that include the VL of any of the antibodies disclosed above. In certain embodiments, the anti-gp120 antibody or gp120-binding fragment thereof includes the VL of any one of Antibody A-1, Antibody 1.1.64-1, Antibody 1.1.90-1, Antibody 2.2.1-1, 2.3.1-1, Antibody 3.1.5-1, Antibody 2.2.5-1, 2.3.5-1, Antibody 1.1.119-1, Antibody 1.1.104-1, Antibody 1.52.64-1, Antibody 2.4.1-1, Antibody 1.1.54-1, or Antibody B-1-1. Also encompassed are anti-gp120 antibodies or gp120-binding fragments thereof that include the VH and VL of any of the antibodies disclosed herein. In certain embodiments, the anti-gp120 antibody or gp120-binding fragment thereof includes the VH and VL of any one of Antibody A-1, Antibody 1.1.64-1, Antibody 1.1.90-1, Antibody 2.2.1-1, Antibody 2.3.1-1, Antibody 3.1.5-1, Antibody 2.2.5-1, Antibody 2.3.5-1, Antibody 1.1.119-1, Antibody 1.1.104-1, Antibody 1.52.64-1, Antibody 2.4.1-1, Antibody 1.1.54-1, or Antibody B-1. Also encompassed by this disclosure are the antibodies comprising the CDRs of any of the foregoing VL and/or VH sequences.

In certain instances, the anti-gp120 antibodies or gp120-binding fragments thereof comprises in addition to the VH amino acid sequence of any of the antibodies disclosed herein, a heavy chain constant region comprising an amino acid sequence below with 0 to 10 (e.g., 1, 2, 3, 4, 5, 6, 7, 8, 9, 10) amino acid substitutions:

(SEQ ID NO: 437)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLAGPDVFLEPPKPKDTLMISRTPEVTCVVV

DVSHEDPEVKFNWYVDGVEVHNAKTKPREEQYNSTYRVVSVLTVLHQDW

LNGKEYKCKVSNKALPLPEEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPGK;

(SEQ ID NO: 438)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLAGPDVFLEPPKPKDTLMISRTPEVTCVVV

DVSHEDPEVKFNWYVDGVEVHNAKTKPREEQYNSTYRVVSVLTVLHQDW

LNGKEYKCKVSNKALPLPEEKTISKAKGQPREPQVYTLPPSREEMTKNQ

```
VSLTCLVKGFYPSDIAVEWESNGQPENNYKTTPPVLDSDGSFFLYSKLT

VDKSRWQQGNVFSCSVLHEALHSHYTQKSLSLSPGK;

(SEQ ID NO: 439)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLGGPDVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPEEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVLHEALHSHYTQKSLSLSPGK;

(SEQ ID NO: 440)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLAGPDVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPEEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVLHEALHSHYTQKSLSLSPGK;

(SEQ ID NO: 441)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV
```

```
EPKSCDKTHTCPPCPAPELLGGPDVFLFPPKPKDTLMISRTPEVTCVVV

DVSHEDPEVKFNWYVDGVEVHNAKTKPREEQYNSTYRVVSVLTVLHQDW

LNGKEYKCKVSNKALPLPEEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVLHEALHSHYTQKSLSLSPGK;
or
                                        (SEQ ID NO: 442)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLGGPSVFLLPPKPKDTLMISRTPEVTCVVV

DVSHEDPEVKFNWYVDGVEVHNAKTKPPEEQYNSTLRVVSILTVLHQDW

LNGKEYKCKVSNKALPAPIEKTISKAKGQPREPQVYTLPPSREEMTKNQ

VSLTCLVKGFYPSDIAVEWESNGQPENNYKTTPLVLDSDGSFFLYSKLT

VDKSRWQQGNVFSCSVLHEALHSHYTQKSLSLSPGK.
```

In certain embodiments, the anti-gp120 antibodies or gp120-binding fragments thereof comprises the VH amino acid sequence set forth in SEQ ID NO: 477 and a heavy chain constant region comprising an amino acid sequence set forth in SEQ ID NO: 438 with 0 to 10 (e.g., 1, 2, 3, 4, 5, 6, 7, 8, 9, 10) amino acid substitutions.

The amino acid sequences of the heavy chain and light chain of exemplary antibodies of the present application are shown in Tables X and XI, respectively. The amino acid sequence of the heavy and light chain of control antibodies used in a number of the assays of this disclosure (e.g., Antibody C and Antibody D-1) are also included.

TABLE X

| SEQ ID NO | Name | Heavy Chain Amino Acid Sequence |
|---|---|---|
| 1 | C | QVRLSQSGGQMKKPGDSMRISCRASGYEFINCPINWIRLAPGKRPEWMGWMKPRWGAVSYA RQLQGRVTMTRDMYSETAFLELRSLTSDDTAVYFCTRGKYCTARDYYNWDFEHWGQGTPVT VSSASTKGPSVFPLAPSSKSTSGGTAALGCLVKDYFPEPVTVSWNSGALTSGVHTFPAVLQ SSGLYSLSSVVTVPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEVHNAKTKPREEQYN STYRVVSVLTVLHQDWLNGKEYKCKVSNKALPAPIEKTISKAKGQPREPQVYTLPPSREEM TKNQVSLTCLVKGFYPSDIAVEWESNGQPENNYKTTPPVLDSDGSFFLYSKLTVDKSRWQQ GNVFSCSVMHEALHNHYTQKSLSLSPGK |
| 2 | A-1 | QVQLLQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 3 | A | QVQLLQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLGGP SVFLFPPKPKDTLMISRTPEVTCVVVDVSHEDPEVKFNWYVDGVEVHNAKTKPREEQYNST YRVVSVLTVLHQDWLNGKEYKCKVSNKALPAPIEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVMHEALHNHYTQKSLSLSPGK |
| 4 | D-1 | QVRLSQSGGQMKKPGDSMRISCRASGYEFINCPINWIRLAPGKRPEWMGWMKPRHGAVSYA RQLQGRVTMTRDMYSETAFLELRSLTSDDTAVYFCTRGKYCTARDYYNWDFEHWGQGTPVT VSSASTKGPSVFPLAPSSKSTSGGTAALGCLVKDYFPEPVTVSWNSGALTSGVHTFPAVLQ SSGLYSLSSVVTVPSSSLGTQTYICNVNHKPSNTKVDKKVEPKSCDKTHTCPPCPAPELLA |

TABLE X-continued

Heavy Chain Sequences

| SEQ ID NO | Name | Heavy Chain Amino Acid Sequence |
|---|---|---|
| | | GPDVFLFPPKPKDTLMISRTPEVTCVVVDVSHEDPEVKFNWYVDGVEVHNAKTKPREEQYN STYRVVSVLTVLHQDWLNGKEYKCKVSNKALPLPEEKTISKAKGQPREPQVYTLPPSREEM TKNQVSLTCLVKGFYPSDIAVEWESNGQPENNYKTTPPVLDSDGSFFLYSKLTVDKSRWQQ GNVFSCSVLHEALHSHYTQKSLSLSPGK |
| 5 | 1v2-1 | QVQLLQSGAAVTKPGASVRVSCEASGYNIRDYFIHWWRQAPGQGLQWVGWINPKTGQPNNP RQFQGRVSLTRHASWDFDTYSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 6 | 1.2.1-1 | QVQLLQSGAEVKKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTMVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 7 | 1.3.1-1 | QVSLLQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 8 | 1.4.1-1 | QVQLVQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 9 | 1.5.1-1 | QVQLVQSGAAVTKPGASVRVSCKASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 10 | 1.6.1-1 | QVQLLQSGAEVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 11 | 1.7.1-1 | QVQLLQSGAEVKKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 12 | 1.8.1-1 | QVQLVQSGAEVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK |

TABLE X-continued

Heavy Chain Sequences

| SEQ ID NO | Name | Heavy Chain Amino Acid Sequence |
|---|---|---|
| | | NQVSLTCLVKGFYPSDIAVEWESNGQPENNYKTTPPVLDSDGSFFLYSKLTVDKSRWQQGN VFSCSVLHEALHSHYTQKSLSLSPGK |
| 13 | 1.9.1-1 | QVQLVQSGAEVKKPGASVRVSCKASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 14 | 1.10.1-1 | QVQLLQSGAAVTKPGASVRVSCEASGYNIRDYFMHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 15 | 1.11.1-1 | QVQLLQSGAAVTKPGASVRVSCEASGYNIRDYFMHWWRQAPGQGLQWVGWINPKTGQPNNP RQFQGRVSLTRHASWDFDTFSAYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 16 | 1.15.1-1 | QVQLLQSGAAVTKPGASVRVSCEASGYNIRDYFIHWWRQAPGQGLQWVGWINPKWGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 17 | 1.16.1-1 | QVQLLQSGAAVTKPGASVRVSCEASGYNIRDYFIHWWRQAPGQGLQWVGWINPKGGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 18 | 1.17.1-1 | QVQLLQSGAAVTKPGASVRVSCEASGYNIRDYFIHWWRQAPGQGLQWVGWINPKAGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 19 | 1.18.1-1 | QVQLLQSGAAVTKPGASVRVSCEASGYNIRDYFIHWWRQAPGQGLQWVGWINPKHGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 20 | 1.19.1-1 | QVQLLQSGAAVTKPGASVRVSCEASGYNIRDYFIHWWRQAPGQGLQWVGWINPKTGQPNNP RQFQGRVTLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |

TABLE X-continued

Heavy Chain Sequences

| SEQ ID NO | Name | Heavy Chain Amino Acid Sequence |
|---|---|---|
| 21 | 1.20.1-1 | QVQLLQSGAAVTKPGASVRVSCEASGYNIRDYFIHWWRQAPGQGLQWVGWINPKTGQPNNP<br>RQFQGRVTMTRHASWDFDTFSFYMDLKALRSDDTAVYFCARQRSDYWDFDVWGSGTQVTVS<br>SASTKGPSVFPLAPSSKSTSGGTAALGCLVKDYFPEPVTVSWNSGALTSGVHTFPAVLQSS<br>GLYSLSSVVTVPSSSLGTQTYICNVNHKPSNTKVDKKVEPKSCDKTHTCPPCPAPELLAGP<br>DVFLFPPKPKDTLMISRTPEVTCVVVDVSHEDPEVKFNWYVDGVEVHNAKTKPREEQYNST<br>YRVVSVLTVLHQDWLNGKEYKCKVSNKALPLPEEKTISKAKGQPREPQVYTLPPSREEMTK<br>NQVSLTCLVKGFYPSDIAVEWESNGQPENNYKTTPPVLDSDGSFFLYSKLTVDKSRWQQGN<br>VFSCSVLHEALHSHYTQKSLSLSPGK |
| 22 | 1.21.1-1 | QVQLLQSGAAVTKPGASVRVSCEASGYNIRDYFIHWWRQAPGQGLQWVGWINPKTGQPNNP<br>RQFQGRVSLTRDASWDFDTFSFYMDLKALRSDDTAVYFCARQRSDYWDFDVWGSGTQVTVS<br>SASTKGPSVFPLAPSSKSTSGGTAALGCLVKDYFPEPVTVSWNSGALTSGVHTFPAVLQSS<br>GLYSLSSVVTVPSSSLGTQTYICNVNHKPSNTKVDKKVEPKSCDKTHTCPPCPAPELLAGP<br>DVFLFPPKPKDTLMISRTPEVTCVVVDVSHEDPEVKFNWYVDGVEVHNAKTKPREEQYNST<br>YRVVSVLTVLHQDWLNGKEYKCKVSNKALPLPEEKTISKAKGQPREPQVYTLPPSREEMTK<br>NQVSLTCLVKGFYPSDIAVEWESNGQPENNYKTTPPVLDSDGSFFLYSKLTVDKSRWQQGN<br>VFSCSVLHEALHSHYTQKSLSLSPGK |
| 23 | 1.22.1-1 | QVQLLQSGAAVTKPGASVRVSCEASGYNIRDYFIHWWRQAPGQGLQWVGWINPKTGQPNNP<br>RQFQGRVSLTRHASTFSFYMDLKALRSDDTAVYFCARQRSDYWDFDVWGSGTQVTVSSAST<br>KGPSVFPLAPSSKSTSGGTAALGCLVKDYFPEPVTVSWNSGALTSGVHTFPAVLQSSGLYS<br>LSSVVTVPSSSLGTQTYICNVNHKPSNTKVDKKVEPKSCDKTHTCPPCPAPELLAGPDVFL<br>FPPKPKDTLMISRTPEVTCVVVDVSHEDPEVKFNWYVDGVEVHNAKTKPREEQYNSTYRVV<br>SVLTVLHQDWLNGKEYKCKVSNKALPLPEEKTISKAKGQPREPQVYTLPPSREEMTKNQVS<br>LTCLVKGFYPSDIAVEWESNGQPENNYKTTPPVLDSDGSFFLYSKLTVDKSRWQQGNVFSC<br>SVLHEALHSHYTQKSLSLSPGK |
| 24 | 1.24.1-1 | QVQLLQSGAAVTKPGASVRVSCEASGYNIRDYFIHWWRQAPGQGLQWVGWINPKTGQPNNP<br>RQFQGRVSLTRHASWDFDTFSFSMDLKALRSDDTAVYFCARQRSDYWDFDVWGSGTQVTVS<br>SASTKGPSVFPLAPSSKSTSGGTAALGCLVKDYFPEPVTVSWNSGALTSGVHTFPAVLQSS<br>GLYSLSSVVTVPSSSLGTQTYICNVNHKPSNTKVDKKVEPKSCDKTHTCPPCPAPELLAGP<br>DVFLFPPKPKDTLMISRTPEVTCVVVDVSHEDPEVKFNWYVDGVEVHNAKTKPREEQYNST<br>YRVVSVLTVLHQDWLNGKEYKCKVSNKALPLPEEKTISKAKGQPREPQVYTLPPSREEMTK<br>NQVSLTCLVKGFYPSDIAVEWESNGQPENNYKTTPPVLDSDGSFFLYSKLTVDKSRWQQGN<br>VFSCSVLHEALHSHYTQKSLSLSPGK |
| 25 | 1.25.1-1 | QVQLLQSGAAVTKPGASVRVSCEASGYNIRDYFIHWWRQAPGQGLQWVGWINPKTGQPNNP<br>RQFQGRVSLTRHASWDFDTFSFYMDLSRLRSDDTAVYFCARQRSDYWDFDVWGSGTQVTVS<br>SASTKGPSVFPLAPSSKSTSGGTAALGCLVKDYFPEPVTVSWNSGALTSGVHTFPAVLQSS<br>GLYSLSSVVTVPSSSLGTQTYICNVNHKPSNTKVDKKVEPKSCDKTHTCPPCPAPELLAGP<br>DVFLFPPKPKDTLMISRTPEVTCVVVDVSHEDPEVKFNWYVDGVEVHNAKTKPREEQYNST<br>YRVVSVLTVLHQDWLNGKEYKCKVSNKALPLPEEKTISKAKGQPREPQVYTLPPSREEMTK<br>NQVSLTCLVKGFYPSDIAVEWESNGQPENNYKTTPPVLDSDGSFFLYSKLTVDKSRWQQGN<br>VFSCSVLHEALHSHYTQKSLSLSPGK |
| 26 | 1.26.1-1 | QVQLLQSGAAVTKPGASVRVSCEASGYNIRDYFIHWWRQAPGQGLQWVGWINPKTGQPNNP<br>RQFQGRVSLTRHASWDFDTFSFYMDLKALRSDDTAYFCARQRSDYWDFDVWGSGTQVTVS<br>SASTKGPSVFPLAPSSKSTSGGTAALGCLVKDYFPEPVTVSWNSGALTSGVHTFPAVLQSS<br>GLYSLSSVVTVPSSSLGTQTYICNVNHKPSNTKVDKKVEPKSCDKTHTCPPCPAPELLAGP<br>DVFLFPPKPKDTLMISRTPEVTCVVVDVSHEDPEVKFNWYVDGVEVHNAKTKPREEQYNST<br>YRVVSVLTVLHQDWLNGKEYKCKVSNKALPLPEEKTISKAKGQPREPQVYTLPPSREEMTK<br>NQVSLTCLVKGFYPSDIAVEWESNGQPENNYKTTPPVLDSDGSFFLYSKLTVDKSRWQQGN<br>VFSCSVLHEALHSHYTQKSLSLSPGK |
| 27 | 1.27.1-1 | QVQLLQSGAAVTKPGASVRVSCEASGYNIRDYFIHWWRQAPGQGLQWVGWINPKTGQPNNP<br>RQFQGRVSLTRHASWDFDTFSFYMDLKALRSDDTAVYFCARQRTDYWDFDVWGSGTQVTVS<br>SASTKGPSVFPLAPSSKSTSGGTAALGCLVKDYFPEPVTVSWNSGALTSGVHTFPAVLQSS<br>GLYSLSSVVTVPSSSLGTQTYICNVNHKPSNTKVDKKVEPKSCDKTHTCPPCPAPELLAGP<br>DVFLFPPKPKDTLMISRTPEVTCVVVDVSHEDPEVKFNWYVDGVEVHNAKTKPREEQYNST<br>YRVVSVLTVLHQDWLNGKEYKCKVSNKALPLPEEKTISKAKGQPREPQVYTLPPSREEMTK<br>NQVSLTCLVKGFYPSDIAVEWESNGQPENNYKTTPPVLDSDGSFFLYSKLTVDKSRWQQGN<br>VFSCSVLHEALHSHYTQKSLSLSPGK |
| 28 | 1.28.1-1 | QVQLLQSGAAVTKPGASVRVSCEASGYNIRDYFIHWWRQAPGQGLQWVGWINPKTGQPNNP<br>RQFQGRVSLTRHASWDFDTFSFYMDLKALRSDDTAYFCARQRTDYWDFDVWGSGTQVTVS<br>SASTKGPSVFPLAPSSKSTSGGTAALGCLVKDYFPEPVTVSWNSGALTSGVHTFPAVLQSS<br>GLYSLSSVVTVPSSSLGTQTYICNVNHKPSNTKVDKKVEPKSCDKTHTCPPCPAPELLAGP<br>DVFLFPPKPKDTLMISRTPEVTCVVVDVSHEDPEVKFNWYVDGVEVHNAKTKPREEQYNST<br>YRVVSVLTVLHQDWLNGKEYKCKVSNKALPLPEEKTISKAKGQPREPQVYTLPPSREEMTK<br>NQVSLTCLVKGFYPSDIAVEWESNGQPENNYKTTPPVLDSDGSFFLYSKLTVDKSRWQQGN<br>VFSCSVLHEALHSHYTQKSLSLSPGK |

TABLE X-continued

Heavy Chain Sequences

| SEQ ID NO | Name | Heavy Chain Amino Acid Sequence |
|---|---|---|
| 29 | 1.29.1-1 | QVQLLQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGQGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 30 | 1.30.1-1 | QVQLLQSGAAVTKPGASVRVSCEASGYNIRDY-FIHWWRQAPGQGLQWVGWINPKTGQPNNP RQFQGRVSLTRHASWDFDTFSFYMDLKALRSDDTAVYFCARQRSDYWDFDVWGSGTMVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 31 | 1.12.15-1 | QVQLLQSGAAVTKPGASVRVSCEASGYNIRDYFIHWVRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 32 | 1.13.15-1 | QVQLLQSGAAVTKPGASVRVSCEASGYNIRDYFMHWVRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 33 | 1.14.15-1 | QVQLLQSGAAVTKPGASVRVSCEASGYNIRDYFMHWVRQAPGQGLQWVGWINPKTGQPNNP RQFQGRVSLTRHASWDFDTFSAYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 34 | 1.31.1-1 | QVQLVQSGAEVTKPGASVRVSCEASGYNIRDYFIHWWRQAPGQGLQWVGWINPKTGQPNNP RQFQGRVSLTRHASWDFDTFSFYMDLKALRSDDTATYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 35 | 1.32.1-1 | QVQLVQSGAEVTKPGASVRVSCEASGYNIRDYFIHWWRQAPGQGLQWVGWINPKTGQPNNP RQFQGRVSLTRHASWDFDTFSFYMDLKALRSDDTAVYFCARQRTDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 36 | 1.33.1-1 | QVQLVQSGAEVKKPGASVRVSCKASGYNIRDYFIHWWRQAPGQGLQWVGWINPKTGQPNNP RQFQGRVTLTRHASWDFDTFSFYMDLKALRSDDTATYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |

TABLE X-continued

Heavy Chain Sequences

| SEQ ID NO | Name | Heavy Chain Amino Acid Sequence |
|---|---|---|
| 37 | 1.34.1-1 | QVQLVQSGAEVKKPGASVRVSCKASGYNIRDYFIHWWRQAPGQGLQWVGWINPKTGQPNNP RQFQGRVTLTRHASWDFDTFSFYMDLKALRSDDTAVYFCARQRTDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 38 | 1.35.1-1 | QVQLVQSGAEVKKPGASVRVSCKASGYNIRDYFMHWWRQAPGQGLQWVGWINPKTGQPNNP RQFQGRVTMTRHASWDFDTFSFYMDLSRLRSDDTATYFCARQRTDYWDFDVWGQGTMVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 39 | 1.36.1-1 | QVQLVQSGAEVKKPGASVRVSCKASGYNIRDYFMHWWRQAPGQGLQWVGWINPKTGQPNNP RQFQGRVTMTRHASWDFDTFSAYMDLSRLRSDDTATYFCARQRTDYWDFDVWGQGTMVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 40 | 1.37.51-1 | QVQLVQSGAEVKKPGASVRVSCKASGYNIRDYFIHWWRQAPGQGLQWVGWINPKTGQPNNP RQFQGRVSLTRHASWDFDTYSFYMDLSRLRSDDTAVYFCARQRSDYWDFDVWGQGTMVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 41 | A-2 | QVQLLQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVMHEALHNHYTQKSLSLSPGK |
| 42 | B-1 | QVHLSQSGAAVTKPGASVRVSCEASGYKISDHFIHWWRQAPGQGLQWVGWINPKTGQPNNP RQFQGRVSLTRQASWDFDTYSFYMDLKAVRSDDTAIYFCARQRSDFWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 43 | A-3 | QVQLLQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLGGP DVFLFPPKPKDTLMISRTPEVTCVVVDVSHEDPEVKFNWYVDGVEVHNAKTKPREEQYNST YRVVSVLTVLHQDWLNGKEYKCKVSNKALPAPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 44 | A-4 | QVQLLQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPAPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 45 | A-5 | QVQLLQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS |

TABLE X-continued

Heavy Chain Sequences

| SEQ ID NO | Name | Heavy Chain Amino Acid Sequence |
|---|---|---|
|  |  | SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLGGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 46 | A-6 | QVQLLQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLGGP SVFLLPPKPKDTLMISRTPEVTCVVVDVSHEDPEVKFNWYVDGVEVHNAKTKPPEEQYNST LRVVSILTVLHQDWLNGKEYKCKVSNKALPAPIEKTISKAKGQPREPQVYTLPPSREEMTK NQVSLTCLVKGFYPSDIAVEWESNGQPENNYKTTPLVLDSDGSFFLYSKLTVDKSRWQQGN VFSCSVLHEALHSHYTQKSLSLSPGK |
| 47 | 1.41.5-1 | QVQLVQSGAEVKKPGASVRVSCKASGYNIRDYFIHWWRQAPGQGLQWVGWINPKTGQPNNP RQFQGRVSLTRHASWDFDTFSFYMDLKALRSDDTAVYFCARQRSDYWDFDVWGQGTMVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 517 | 2.2.1-1 | QVHLSQSGAAVTKPGASVRVSCEASGYKIRDHFIHWWRQAPGQGLQWVGWINPKTGQPNNP RQFQGRVSLTRHASWDFDTFSFYMDLKAVRSDDTAIYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 518 | 2.3.1-1 | QVHLSQSGAAVTKPGASVRVSCEASGYNIRDYFIHWWRQAPGQGLQWVGWINPKTGQPNNP RQFQGRVSLTRHASWDFDTFSFYMDLKAVRSDDTAIYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 519 | 1.42.1-1 | QVHLLQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 520 | 1.43.1-1 | QVQLSQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 521 | 1.44.1-1 | QVQLLQSGAAVTKPGASVRVSCEASGYKIRDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 522 | 1.45.1-1 | QVQLLQSGAAVTKPGASVRVSCEASGYNISDYFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP |

TABLE X-continued

Heavy Chain Sequences

| SEQ ID NO | Name | Heavy Chain Amino Acid Sequence |
|---|---|---|
| | | DVFLFPPKPKDTLMISRTPEVTCVVVDSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 523 | 1.46.1-1 | QVQLLQSGAAVTKPGASVRVSCEASGYNIRDHFIHWWRQAPGQGLQWVGWINPKTGQPNNP RQFQGRVSLTRHASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 524 | 1.47.1-1 | QVQLLQSGAAVTKPGASVRVSCEASGYNIRDYFIHWWRQAPGQGLQWVGWINPKTGQPNNP RQFQGRVSLTRQASWDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 526 | 1.49.1-1 | QVQLLQSGAAVTKPGASVRVSCEASGYNIRDYFIHWWRQAPGQGLQWVGWINPKTGQPNNP RQFQGRVSLTRHASWDFDTFSFYMDLKAVRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 527 | 1.50.1-1 | QVQLLQSGAAVTKPGASVRVSCEASGYNIRDYFIHWWRQAPGQGLQWVGWINPKTGQPNNP RQFQGRVSLTRHASWDFDTFSFYMDLKALRSDDTAIYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 528 | 1.51.1-1 | QVQLLQSGAAVTKPGASVRVSCEASGYNIRDYFIHWWRQAPGQGLQWVGWINPKTGQPNNP RQFQGRVSLTRHASWDFDTFSFYMDLKALRSDDTAVYFCARQRSDFWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 529 | 1.52.64-1 | QVQLLQSGAAVTKPGASVRVSCEASGYNIRDYFIHWWRQAPGQGLQWVGWINPKTGQPNNP RQFQGRVSLTRHASFDFDTFSFYMDLKALRSDDTAVYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |
| 530 | 2.4.1-1 | QVHLSQSGAAVTKPGASVRVSCEASGYKIRDHFIHWWRQAPGQGLQWVGWINPKTGQPNNP RQFQGRVSLTRHASFDFDTFSFYMDLKAVRSDDTAIYFCARQRSDYWDFDVWGSGTQVTVS SASTKGPSVFPLAPSSKSTSGGTAALGCLVKDYFPEPVTVSWNSGALTSGVHTFPAVLQSS GLYSLSSVVTVPSSSLGTQTYICNVNHKPSNTKVDKKVEPKSCDKTHTCPPCPAPELLAGP DVFLFPPKPKDTLMISRTPEVTCVVVDVSHEDPEVKFNWYVDGVEVHNAKTKPREEQYNST YRVVSVLTVLHQDWLNGKEYKCKVSNKALPLPEEKTISKAKGQPREPQVYTLPPSREEMTK NQVSLTCLVKGFYPSDIAVEWESNGQPENNYKTTPPVLDSDGSFFLYSKLTVDKSRWQQGN VFSCSVLHEALHSHYTQKSLSLSPGK |

TABLE XI

Light Chain Sequences

| SEQ ID NO | Name | Light Chain Amino Acid Sequence |
|---|---|---|
| 48 | C | EIVLTQSPGTLSLSPGETAIISCRTSQYGSLAWYQQRPGQAPRLVIYSGSTRAAGIPDRFS GSRWGPDYNLTISNLESGDFGVYYCQQYEFFGQGTKVQVDIKRTVAAPSVFIFPPSDEQLK SGTASVVCLLNNFYPREAKVQWKVDNALQSGNSQESVTEQDSKDSTYSLSSTLTLSKADYE KHKVYACEVTHQGLSSPVTKSFNRGEC |
| 49 | A-1 | DIQMTQSPSSLSASVGDTVTITCQANGYLNWYQQRRGKAPKLLIYDGSKLERGVPSRFSGR RWGQEYNLTINNLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |
| 50 | D-1 | SLTQSPGTLSLSPGETAIISCRTSQYGSLAWYQQRPGQAPRLVIYSGSTRAAGIPDRFSGS RWGPDYNLTISNLESGDFGVYYCQQYEFFGQGTKVQVDIKRTVAAPSVFIFPPSDEQLKSG TASVVCLLNNFYPREAKVQWKVDNALQSGNSQESVTEQDSKDSTYSLSSTLTLSKADYEKH KVYACEVTHQGLSSPVTKSFNRGEC |
| 51 | 1.1.3-1 | EIQMTQSPSSLSASVGDTVTITCQANGYLNWYQQRRGKAPKLLIYDGSKLERGVPSRFSGR RWGQEYNLTINNLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |
| 52 | 1.1.4-1 | DIQMTQSPSSLSASVGDRVTITCQANGYLNWYQQRRGKAPKLLIYDGSKLERGVPSRFSGR RWGQEYNLTINNLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |
| 53 | 1.1.5-1 | DIQMTQSPSSLSASVGDTVTITCQANGYLNWYQQKPGKAPKLLIYDGSKLERGVPSRFSGR RWGQEYNLTINNLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |
| 54 | 1.1.6-1 | DIQMTQSPSSLSASVGDTVTITCQANGYLNWYQQRRGKAPKLLIYDASKLERGVPSRFSGR RWGQEYNLTINNLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |
| 55 | 1.1.7-1 | DIQMTQSPSSLSASVGDTVTITCQANGYLNWYQQRRGKAPKLLIYDGSNLERGVPSRFSGR RWGQEYNLTINNLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |
| 56 | 1.1.8-1 | DIQMTQSPSSLSASVGDTVTITCQANGYLNWYQQRRGKAPKLLIYDASNLERGVPSRFSGR RWGQEYNLTINNLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |
| 57 | 1.1.9-1 | DIQMTQSPSSLSASVGDTVTITCQANGYLNWYQQRRGKAPKLLIYDGSKLETGVPSRFSGR RWGQEYNLTINNLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |
| 58 | 1.1.10-1 | DIQMTQSPSSLSASVGDTVTITCQANGYLNWYQQRRGKAPKLLIYDGSKLERGVPSRFSGR RWGQEYTLTINNLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |
| 59 | 1.1.11-1 | DIQMTQSPSSLSASVGDTVTITCQANGYLNWYQQRRGKAPKLLIYDGSKLERGVPSRFSGS RWGQEYTLTINNLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |
| 60 | 1.1.12-1 | DIQMTQSPSSLSASVGDTVTITCQANGYLNWYQQRRGKAPKLLIYDGSKLERGVPSRFSGR RWGQEYNLTISSLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |
| 61 | 1.1.13-1 | DIQMTQSPSSLSASVGDTVTITCQANGYLNWYQQRRGKAPKLLIYDGSKLERGVPSRFSGS RWGQEYTLTISSLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |
| 62 | 1.1.14-1 | DIQMTQSPSSLSASVGDTVTITCQANGYLNWYQQRRGKAPKLLIYDGSKLERGVPSRFSGS GSGTDFTFTINNLQPEDIATYFCQVYEFVVPGTRLDLKRTVAAPSVFIFPPSDEQLKSGTA SVVCLLNNFYPREAKVQWKVDNALQSGNSQESVTEQDSKDSTYSLSSTLTLSKADYEKHKV YACEVTHQGLSSPVTKSFNRGEC |

TABLE XI-continued

Light Chain Sequences

| SEQ ID NO | Name | Light Chain Amino Acid Sequence |
|---|---|---|
| 63 | 1.1.15-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFFVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 64 | 1.1.16-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 65 | 1.1.17-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 66 | 1.1.18-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVSPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 67 | 1.1.19-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVTPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 68 | 1.1.20-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVVPGTNLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 69 | 1.1.21-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVGPGTNLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 70 | 1.1.22-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVSPGTNLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 71 | 1.1.23-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVTPGTNLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 72 | 1.1.24-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVVPGTRVDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 73 | 1.1.25-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVVPGTNVDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 74 | 1.1.26-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVVPGTRLDIKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 75 | 1.1.27-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVVPGTRVDIKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 76 | 1.1.28-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVVPGTNVDIKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |

TABLE XI-continued

Light Chain Sequences

| SEQ ID NO | Name | Light Chain Amino Acid Sequence |
|---|---|---|
| 77 | 1.1.29-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVGPGTNVDIKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 78 | 1.1.30-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFVTPGTNVDIKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 79 | 1.1.31-1 | DIQMTQSPSSLSASVGDTVTITCQANGYLNWYQQRRGKAPKLLIYDGSKLERGVPSRFSGR<br>RWGQEYTLTISSLQPEDIATYFCQVYEFVVPGTNLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 80 | 1.1.32-1 | DIQMTQSPSSLSASVGDTVTITCQANGYLNWYQQRRGKAPKLLIYDGSKLERGVPSRFSGR<br>RWGQEYTLTTISSLQPEDIATYFCQVYEFVTPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 81 | 1.1.33-1 | DIQMTQSPSSLSASVGDTVTITCQANGYLNWYQQRRGKAPKLLIYDGSNLERGVPSRFSGR<br>RWGQEYTLTISSLQPEDIATYFCQVYEFVVPGTNLDIKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 82 | 1.1.34-1 | DIQMTQSPSSLSASVGDTVTITCQANGYLNWYQQRRGKAPKLLIYDGSNLERGVPSRFSGR<br>RWGQEYTLTISSLQPEDIATYFCQVYEFVTPGTRLDIKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 83 | 1.1.35-1 | DIQMTQSPSSLSASVGDRVTITCQANGYLNWYQQKPGKAPKLLIYDGSNLETGVPSRFSGS<br>RWGQEYTLTISSLQPEDIATYFCQVYEFVGPGTNLDIKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 84 | 1.1.36-1 | DIQMTQSPSSLSASVGDRVTITCQANGYLNWYQQKPGKAPKLLIYDGSNLETGVPSRFSGS<br>RWGQEYTLTISSLQPEDIATYFCQVYEFVTPGTNLDIKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 85 | 1.1.37-1 | DIQMTQSPSSLSASVGDTVTITCQANGYLNWYQQRRGKAPKLLIYDGSKLERGVPSRFSGR<br>RWGQEYTFTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 86 | 1.1.38-1 | DIQMTQSPSSLSASVGDTVTITCQANGYLNWYQQRRGKAPKLLIYDGSKLERGVPSRFSGR<br>RWGQEYSLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 87 | 1.1.39-1 | DIQMTQSPSSLSASVGDTVTITCQANGYLNWYQQRRGKAPKLLIYDGSKLERGVPSRFSGR<br>RWGQEYSFTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 88 | 1.1.40-1 | DIQMTQSPSSLSASVGDTVTITCQANGYLNWYQQRRGKAPKLLIYDGSKLERGVPSRFSGR<br>RWGQEYALTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 89 | 1.1.41-1 | DIQMTQSPSSLSASVGDTVTITCQANGYLNWYQQRRGKAPKLLIYDGSKLERGVPSRFSGR<br>RWGQEYAFTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 90 | 1.1.42-1 | DIQMTQSPSSLSASVGDTVTITCQANGYLNWYQQRRGKAPKLLIYDGSKLERGVPSRFSGR<br>RWGQEYHLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |

TABLE XI-continued

Light Chain Sequences

| SEQ ID NO | Name | Light Chain Amino Acid Sequence |
|---|---|---|
| 91 | 1.1.43-1 | DIQMTQSPSSLSASVGDTVTITCQANGYLNWYQQRRGKAPKLLIYDGSKLERGVPSRFSGR<br>RWGQEYHFTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 92 | 1.1.44-1 | DIQMTQSPSSLSASVGDTVTITCQANGYLNWYQQRRGKAPKLLIYDGSKLERGVPSRFSGR<br>RWGQEYQLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 93 | 1.1.45-1 | DIQMTQSPSSLSASVGDTVTITCQANGYLNWYQQRRGKAPKLLIYDGSKLERGVPSRFSGR<br>RWGQEYQFTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 94 | 1.1.46-1 | DIQMTQSPSSLSASVGDTVTITCQANGYLNWYQQRRGKAPKLLIYDGSKLERGVPSRFSGR<br>RWGQEYNLKINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 95 | 1.1.47-1 | DIQMTQSPSSLSASVGDTVTITCQANGYLNWYQQRRGKAPKLLIYDGSKLERGVPSRFSGR<br>RWGQEYNFKINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 96 | 1.1.48-1 | DIQMTQSPSSLSASVGDTVTITCQANGYLNWYQQRRGKAPKLLIYDGSKLERGVPSRFSGR<br>RWGQEYNLAINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 97 | 1.1.49-1 | DIQMTQSPSSLSASVGDTVTITCQANGYLNWYQQRRGKAPKLLIYDGSKLERGVPSRFSGR<br>RWGQEYNFAINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 98 | 1.37.51-1 | DIQMTQSPSSLSASVGDRVTITCQANGYLNWYQQKPGKAPKLLIYDGSKLETGVPSRFSGS<br>RWGQEYTLTINNLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 99 | 1.8.52-1 | DIQMTQSPSSLSASVGDRVTITCQANGYLNWYQQKPGKAPKLLIYDGSKLERGVPSRFSGR<br>RWGQEYTLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 100 | 1.1.54-1 | DIQMTQSPSSLSASVGDTATITCQANGYLNWYQQRRGKAPKLLIYDGSKLERGVPSRFSGR<br>RWGQEYTLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 101 | B-1 | DIQMTQSPSSLSARVGDTVTITCQANGYLNWYQQRRGKAPKLLIYDGSKLERGVPARFSGR<br>RWGQEYNLTINNLQPEDVATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 102 | 2.1.2-1 | DIQMTQSPSSLSARVGDTVTITCQANGYLNWYQQRRGKAPKLLIYDGSKLERGVPARFSGR<br>RWGQEYHLTINNLQPEDVATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 103 | 1.1.64-1 | DIQMTQSPSSLSASVGDTATITCQANGYLNWYQQRRGKAPKLLIYDGSKLERGVPSRFSGR<br>RWGQEYNLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 104 | 1.1.67-1 | DIQMTQSPSSLSASVGDTATITCQANGYLNWYQQRRGKAPKLLIYDGSKLERGVPSRFSGR<br>RWGQEYNLTINNLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |

TABLE XI-continued

Light Chain Sequences

| SEQ ID NO | Name | Light Chain Amino Acid Sequence |
|---|---|---|
| 105 | 1.1.72-1 | DIQMTQSPSSLSASVGDTVTITCQANGYLNWYQQRRGKAPKLLIYDGSKLERGVPSRFSGR<br>RWGQEYHLTINNLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 106 | 1.1.75-1 | DIQMTQSPSSLSASVGDTATITCQANGYLNWYQQRRGKAPKLLIYDGSKLERGVPSRFSGR<br>RWGQEYHLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 107 | 1.1.78-1 | DIQMTQSPSSLSASVGDTATITCQANGYLNWYQQRRGKAPKLLIYDGSKLERGVPSRFSGR<br>RWGQEYHLTINNLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 108 | 1.41.81-1 | DIQMTQSPSSLSASVGDTVTITCQANGYLNWYQQKPGKAPKLLIYDGSKLERGVPSRFSGR<br>RWGQEYNLTINNLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 109 | 1.1.82-1 | DIQMTQSPSSLSASVGDRVTITCQANGYLNWYQQRRGKAPKLLIYDGSKLERGVPSRFSGS<br>RWGQEYNLTISSLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 110 | 1.41.83-1 | DIQMTQSPSSLSASVGDRVTITCQANGYLNWYQQKPGKAPKLLIYDGSKLERGVPSRFSGS<br>RWGQEYNLTISSLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 111 | 1.1.84-1 | DIQMTQSPSSLSASVGDRVTITCQANGYLNWYQQRRGKAPKLLIYDGSKLERGVPSRFSGS<br>RWGQEYNLTISSLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 112 | 1.41.85-1 | DIQMTQSPSSLSASVGDRVTITCQANGYLNWYQQKPGKAPKLLIYDGSKLERGVPSRFSGS<br>RWGQEYNLTISSLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 113 | 1.41.86-1 | DIQMTQSPSSLSASVGDTATITCQANGYLNWYQQKPGKAPKLLIYDGSKLERGVPSRFSGR<br>RWGQEYNLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 114 | 1.41.87-1 | DIQMTQSPSSLSASVGDTATITCQANGYLNWYQQKPGKAPKLLIYDGSKLERGVPSRFSGR<br>RWGQEYNLTINNLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 115 | 1.1.88-1 | DIQMTQSPSSLSASVGDRATITCQANGYLNWYQQRRGKAPKLLIYDGSKLERGVPSRFSGS<br>RWGQEYNLTISSLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 116 | 1.41.89-1 | DIQMTQSPSSLSASVGDRATITCQANGYLNWYQQKPGKAPKLLIYDGSKLERGVPSRFSGS<br>RWGQEYNLTISSLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 117 | 1.1.90-1 | DIQMTQSPSSLSASVGDRATITCQANGYLNWYQQRRGKAPKLLIYDGSKLERGVPSRFSGS<br>RWGQEYNLTISSLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 118 | 1.41.91-1 | DIQMTQSPSSLSASVGDRATITCQANGYLNWYQQKPGKAPKLLIYDGSKLERGVPSRFSGS<br>RWGQEYNLTISSLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |

TABLE XI-continued

Light Chain Sequences

| SEQ ID NO | Name | Light Chain Amino Acid Sequence |
|---|---|---|
| 119 | 1.41.92-1 | DIQMTQSPSSLSASVGDTVTITCQANGYLNWYQQKPGKAPKLLIYDGSKLERGVPSRFSGR<br>RWGQEYHLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 120 | 1.41.93-1 | DIQMTQSPSSLSASVGDTVTITCQANGYLNWYQQKPGKAPKLLIYDGSKLERGVPSRFSGR<br>RWGQEYHLTINNLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 121 | 1.1.94-1 | DIQMTQSPSSLSASVGDRVTITCQANGYLNWYQQRRGKAPKLLIYDGSKLERGVPSRFSGS<br>RWGQEYHLTISSLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 122 | 1.41.95-1 | DIQMTQSPSSLSASVGDRVTITCQANGYLNWYQQKPGKAPKLLIYDGSKLERGVPSRFSGS<br>RWGQEYHLTISSLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 123 | 1.1.96-1 | DIQMTQSPSSLSASVGDRVTITCQANGYLNWYQQRRGKAPKLLIYDGSKLERGVPSRFSGS<br>RWGQEYHLTISSLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 124 | 1.41.97-1 | DIQMTQSPSSLSASVGDRVTITCQANGYLNWYQQKPGKAPKLLIYDGSKLERGVPSRFSGS<br>RWGQEYHLTISSLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 125 | 1.41.98-1 | DIQMTQSPSSLSASVGDTATITCQANGYLNWYQQKPGKAPKLLIYDGSKLERGVPSRFSGR<br>RWGQEYHLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 126 | 1.41.99-1 | DIQMTQSPSSLSASVGDTATITCQANGYLNWYQQKPGKAPKLLIYDGSKLERGVPSRFSGR<br>RWGQEYHLTINNLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 127 | 1.1.100-1 | DIQMTQSPSSLSASVGDRATITCQANGYLNWYQQRRGKAPKLLIYDGSKLERGVPSRFSGS<br>RWGQEYHLTISSLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 128 | 1.41.101-1 | DIQMTQSPSSLSASVGDRATITCQANGYLNWYQQKPGKAPKLLIYDGSKLERGVPSRFSGS<br>RWGQEYHLTISSLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 129 | 1.1.102-1 | DIQMTQSPSSLSASVGDRATITCQANGYLNWYQQRRGKAPKLLIYDGSKLERGVPSRFSGS<br>RWGQEYHLTISSLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 130 | 1.41.103-1 | DIQMTQSPSSLSASVGDRATITCQANGYLNWYQQKPGKAPKLLIYDGSKLERGVPSRFSGS<br>RWGQEYHLTISSLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 131 | 1.1.110-1 | DIQMTQSPSSLSASVGDTVTITCQANGYLNWYQQRRGKAPKLLIYDGSKLERGVPSRFSGT<br>RRGQDYIFSINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 132 | 1.1.111-1 | DIQMTQSPSSLSASVGDTVTITCQANGYLNWYQQRRGKAPKLLIYDGSKLERGVPSRFSGR<br>RFGQDYILTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |

TABLE XI-continued

Light Chain Sequences

| SEQ ID NO | Name | Light Chain Amino Acid Sequence |
|---|---|---|
| 133 | 1.1.112-1 | DIQMTQSPSSLSASVGDTVTITCQANGYLNWYQQRRGKAPKLLIYDGSKLERGVPSRFSGS<br>RFGQKYQLSINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 134 | 1.1.113-1 | DIQMTQSPSSLSASVGDTATITCQANGYLNWYQQRRGKAPKLLIYDGSKLERGVPSRFSGR<br>RFGQDYILTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 135 | 2.1.3-1 | DIQMTQSPSSLSARVGDTVTITCQANGYLNWYQQRRGKAPKLLIYDGSKLERGVPARFSGR<br>RFGQDYILTINNLQPEDVATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 136 | 2.1.4-1 | DIQMTQSPSSLSARVGDTATITCQANGYLNWYQQRRGKAPKLLIYDGSKLERGVPARFSGR<br>RFGQDYILTINNLQPEDVATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 531 | 3.1.8-1 | DIQMTQSPSSLSARVGDTATITCQANGYLNWYQQRRGKAPKLLIYDGSKLERGVPARFSGR<br>RWGQEYNLTINNLQPEDVATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 532 | 3.1.9-1 | DIQMTQSPSSLSARVGDTATITCQANGYLNWYQQRRGKAPKLLIYDGSKLERGVPARFSGR<br>RWGQEYNLTINNLQPEDVATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 533 | 1.1.115-1 | DIQMTQSPSSLSASVGDTVTITCQANGYLNWYQQRRGKAPKLLIYDGSKLERGVPSRFSGR<br>RWGQEYILTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 534 | 3.1.10-1 | DIQMTQSPSSLSARVGDTVTITCQANGYLNWYQQRRGKAPKLLIYDGSKLERGVPARFSGR<br>RWGQEYILTINNLQPEDVATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 535 | 1.1.116-1 | DIQMTQSPSSLSASVGDTATITCQANGYLNWYQQRRGKAPKLLIYDGSKLERGVPSRFSGR<br>RWGQEYILTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 536 | 3.1.11-1 | DIQMTQSPSSLSARVGDTATITCQANGYLNWYQQRRGKAPKLLIYDGSKLERGVPARFSGR<br>RWGQEYILTINNLQPEDVATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 537 | 1.1.117-1 | DIQMTQSPSSLSASVGDTATITCQANGYLNWYQQRRGKAPKLLIYDGSKLERGVPSRFSGR<br>RWGQEYILTINNLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 538 | 3.1.12-1 | DIQMTQSPSSLSARVGDTATITCQANGYLNWYQQRRGKAPKLLIYDGSKLERGVPARFSGR<br>RWGQEYILTINNLQPEDVATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 539 | 1.1.118-1 | DIQMTQSPSSLSASVGDRATITCQANGYLNWYQQRRGKAPKLLIYDGSKLERGVPSRFSGS<br>RWGQEYILTISSLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 540 | 3.1.13-1 | DIQMTQSPSSLSARVGDRATITCQANGYLNWYQQRRGKAPKLLIYDGSKLERGVPARFSGS<br>RWGQEYILTISSLQPEDVATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |

TABLE XI-continued

Light Chain Sequences

| SEQ ID NO | Name | Light Chain Amino Acid Sequence |
|---|---|---|
| 541 | 3.1.14-1 | DIQMTQSPSSLSARVGDTVTITCQANGYLNWYQQRRGKAPKLLIYDGSKLERGVPARFSGR<br>RWGQEYTLTINNLQPEDVATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 542 | 3.1.5-1 | DIQMTQSPSSLSARVGDTATITCQANGYLNWYQQRRGKAPKLLIYDGSKLERGVPARFSGR<br>RWGQEYTLTINNLQPEDVATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 543 | 3.1.15-1 | DIQMTQSPSSLSARVGDTATITCQANGYLNWYQQRRGKAPKLLIYDGSKLERGVPARFSGR<br>RWGQEYTLTINNLQPEDVATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 544 | 1.1.119-1 | DIQMTQSPSSLSASVGDRATITCQANGYLNWYQQRRGKAPKLLIYDGSKLERGVPSRFSGS<br>RWGQEYTLTISSLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 545 | 3.1.7-1 | DIQMTQSPSSLSARVGDRATITCQANGYLNWYQQRRGKAPKLLIYDGSKLERGVPARFSGS<br>RWGQEYTLTISSLQPEDVATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 546 | 3.1.16-1 | DIQMTQSPSSLSARVGDTATITCQANGYLNWYQQRRGKAPKLLIYDGSKLERGVPARFSGR<br>RWGQEYHLTINNLQPEDVATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 547 | 3.1.17-1 | DIQMTQSPSSLSARVGDTATITCQANGYLNWYQQRRGKAPKLLIYDGSKLERGVPARFSGR<br>RWGQEYHLTINNLQPEDVATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 548 | 3.1.18-1 | DIQMTQSPSSLSARVGDRATITCQANGYLNWYQQRRGKAPKLLIYDGSKLERGVPARFSGS<br>RWGQEYHLTISSLQPEDVATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 549 | 1.1.120-1 | DIQMTQSPSSLSASVGDTATITCQANGYLNWYQQRRGKAPKLLIYDGSKLERGVPSRFSGR<br>RWGQDYILTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 550 | 3.1.19-1 | DIQMTQSPSSLSARVGDTATITCQANGYLNWYQQRRGKAPKLLIYDGSKLERGVPARFSGR<br>RWGQDYILTINNLQPEDVATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 551 | 1.1.121-1 | DIQMTQSPSSLSASVGDTATITCQANGYLNWYQQRRGKAPKLLIYDGSKLERGVPSRFSGR<br>RFGQEYILTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 552 | 3.1.20-1 | DIQMTQSPSSLSARVGDTATITCQANGYLNWYQQRRGKAPKLLIYDGSKLERGVPARFSGR<br>RFGQEYILTINNLQPEDVATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 553 | 1.1.122-1 | DIQMTQSPSSLSASVGDTATITCQANGYLNWYQQRRGKAPKLLIYDGSKLERGVPSRFSGR<br>RWGQEYVLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 554 | 1.1.123-1 | DIQMTQSPSSLSASVGDTATITCQANGYLNWYQQRRGKAPKLLIYDGSKLERGVPSRFSGR<br>RWGQEYLLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |

TABLE XI-continued

Light Chain Sequences

| SEQ ID NO | Name | Light Chain Amino Acid Sequence |
|---|---|---|
| 555 | 1.1.124-1 | DIQMTQSPSSLSASVGDTATITCQANGYLNWYQQRRGKAPKLLIYDGSKLERGVPSRFSGR<br>RWGQEYMLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 556 | 1.1.125-1 | DIQMTQSPSSLSASVGDTATITCQANGYLNWYQQRRGKAPKLLIYDGSKLERGVPSRFSGR<br>RWGQEYALTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 557 | 1.1.126-1 | DIQMTQSPSSLSASVGDTATITCQANGYLNWYQQRRGKAPKLLIYDGSKLERGVPSRFSGR<br>RWGQEYSLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 558 | 1.1.127-1 | DIQMTQSPSSLSASVGDTATITCQANGYLNWYQQRRGKAPKLLIYDGSKLERGVPSRFSGR<br>RWGQEYFLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 559 | 1.1.128-1 | DIQMTQSPSSLSASVGDTATITCQANGYLNWYQQRRGKAPKLLIYDGSKLERGVPSRFSGT<br>RWGQEYILTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 560 | 1.1.129-1 | DIQMTQSPSSLSASVGDTATITCQANGYLNWYQQRRGKAPKLLIYDGSKLERGVPSRFSGR<br>RRGQEYILTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 561 | 1.1.130-1 | DIQMTQSPSSLSASVGDTATITCQANGYLNWYQQRRGKAPKLLIYDGSKLERGVPSRFSGR<br>RYGQEYILTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 562 | 1.1.131-1 | DIQMTQSPSSLSASVGDTATITCQANGYLNWYQQRRGKAPKLLIYDGSKLERGVPSRFSGT<br>RWGQDYILTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 563 | 1.1.132-1 | DIQMTQSPSSLSARVGDTVTITCQANGYLNWYQQRRGKAPKLLIYDGSKLERGVPSRFSGR<br>RWGQEYNLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 564 | 1.1.133-1 | DIQMTQSPSSLSASVGDTVTITCQANGYLNWYQQRRGKAPKLLIYDGSKLERGVPARFSGR<br>RWGQEYNLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 565 | 1.1.134-1 | DIQMTQSPSSLSASVGDTVTITCQANGYLNWYQQRRGKAPKLLIYDGSKLERGVPSRFSGR<br>RWGQEYNLTINNLQPEDVATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 566 | 1.1.135-1 | DIQMTQSPSSLSASVGDTVTITCQANGYLNWYQQRRGKAPKLLIYDGSKLERGVPSRFSGR<br>RWGQEYNLTINNLQPEDIATYFCQVYEFIVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 568 | 1.1.138-1 | DIQMTQSPSSLSASVGDTVTITCQATGYLNWYQQRRGKAPKLLIYDGSKLERGVPSRFSGR<br>RWGQEYNLTINNLQPEDIATYFCQVYEFVVPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |
| 567 | 1.1.104-1 | DIQMTQSPSSLSASVGDTATITCQANGYLNWYQQRRGKAPKLLIYDGSKLERGVPSRFSGR<br>RWGQEYTLTINNLQPEDIATYFCQVYEFFGPGTRLDLKRTVAAPSVFIFPPSDEQLKSGTA<br>SVVCLLNNFYPREAKVQWKVDNALQSGNSQESVTEQDSKDSTYSLSSTLTLSKADYEKHKV<br>YACEVTHQGLSSPVTKSFNRGEC |

In some embodiments, the anti-gp120 antibodies or gp120-binding fragments described herein have a heavy chain (HC) that is at least 80%, at least 85%, at least 90%, at least 91%, at least 92%, at least 93%, at least 94%, at least 95%, at least 96%, at least 97%, at least 98%, at least 99%, or 100%, identical to an amino acid sequence selected from the group consisting of SEQ ID NOs: 1-47 and 517-530 and a light chain (LC) that is at least 80%, at least 85%, at least 90%, at least 91%, at least 92%, at least 93%, at least 94%, at least 95%, at least 96%, at least 97%, at least 98%, at least 99%, or 100%, identical to an amino acid sequence selected from the group consisting of SEQ ID NOs: 48-136 and 531-567. In some embodiments, the anti-gp120 antibodies or gp120-binding fragments described herein have a HC selected from the group consisting of SEQ ID NOs: 1-47 and 517-530, and a LC selected from the group consisting of SEQ ID NOs: 48-136 and 531-567. In some embodiments, the anti-gp120 antibodies or gp120-binding fragments described herein have a heavy chain (HC) that is at least 80%, at least 85%, at least 90%, at least 91%, at least 92%, at least 93%, at least 94%, at least 95%, at least 96%, at least 97%, at least 98%, at least 99%, such as 100%, identical to the amino acid sequence set forth in SEQ ID NO: 529 and a light chain (LC) that is at least 80%, at least 85%, at least 90%, at least 91%, at least 92%, at least 93%, at least 94%, at least 95%, at least 96%, at least 97%, at least 98%, at least 99%, such as 100%, identical to the amino acid sequence set forth in SEQ ID NO: 103. In some embodiments, the anti-gp120 antibodies or gp120-binding fragments described herein have a HC with the amino acid sequence set forth in SEQ ID NO: 529, and a LC with the amino acid sequence set forth in SEQ ID NO: 103.

Encompassed by this disclosure are anti-gp120 antibodies or gp120-binding fragments thereof that include the heavy chain of any of the antibodies disclosed herein. In certain embodiments, the anti-gp120 antibody or gp120-binding fragment thereof includes the heavy chain of any one of Antibody A-1, Antibody 1.1.64-1, Antibody 1.1.90-1, Antibody 2.2.1-1, Antibody 2.3.1-1, Antibody 3.1.5-1, Antibody 2.2.5-1, Antibody 2.3.5-1, Antibody 1.1.119-1, Antibody 1.1.104-1, Antibody 1.52.64-1, Antibody 2.4.1-1, Antibody 1.1.54-1, or Antibody B-1. In certain embodiments, the anti-gp120 antibody or gp120-binding fragment thereof includes the heavy chain of Antibody 1.52.64-1.

Encompassed by this disclosure are anti-gp120 antibodies or gp120-binding fragments thereof that include the light chain of any of the antibodies disclosed herein. In certain embodiments, the anti-gp120 antibody or gp120-binding fragment thereof includes the light chain of any one of Antibody A-1, Antibody 1.1.64-1, Antibody 1.1.90-1, Antibody 2.2.1-1, Antibody 2.3.1-1, Antibody 3.1.5-1, Antibody 2.2.5-1, Antibody 2.3.5-1, Antibody 1.1.119-1, Antibody 1.1.104-1, Antibody 1.52.64-1, Antibody 2.4.1-1, Antibody 1.1.54-1, or Antibody B-1. In certain embodiments, the anti-gp120 antibody or gp120-binding fragment thereof includes the light chain of Antibody 1.52.64-1.

Also encompassed are anti-gp120 antibodies or gp120-binding fragments thereof that include the heavy and light chain of any of the antibodies disclosed herein. In certain embodiments, the anti-gp120 antibody or gp120-binding fragment thereof includes the heavy and light chains of any one of Antibody A-1, Antibody 1.1.64-1, Antibody 1.1.90-1, Antibody 2.2.1-1, Antibody 2.3.1-1, Antibody 3.1.5-1, Antibody 2.2.5-1, Antibody 2.3.5-1, Antibody 1.1.119-1, Antibody 1.1.104-1, Antibody 1.52.64-1, Antibody 2.4.1-1, Antibody 1.1.54-1, or Antibody B-1. In certain embodiments, the anti-gp120 antibody or gp120-binding fragment thereof includes the heavy and light chains of Antibody 1.52.64-1.

Encompassed by this disclosure are anti-gp120 antibodies or gp120-binding fragments thereof that include any of the VH and/or VL amino acid substitutions shown above.

Figure 2:
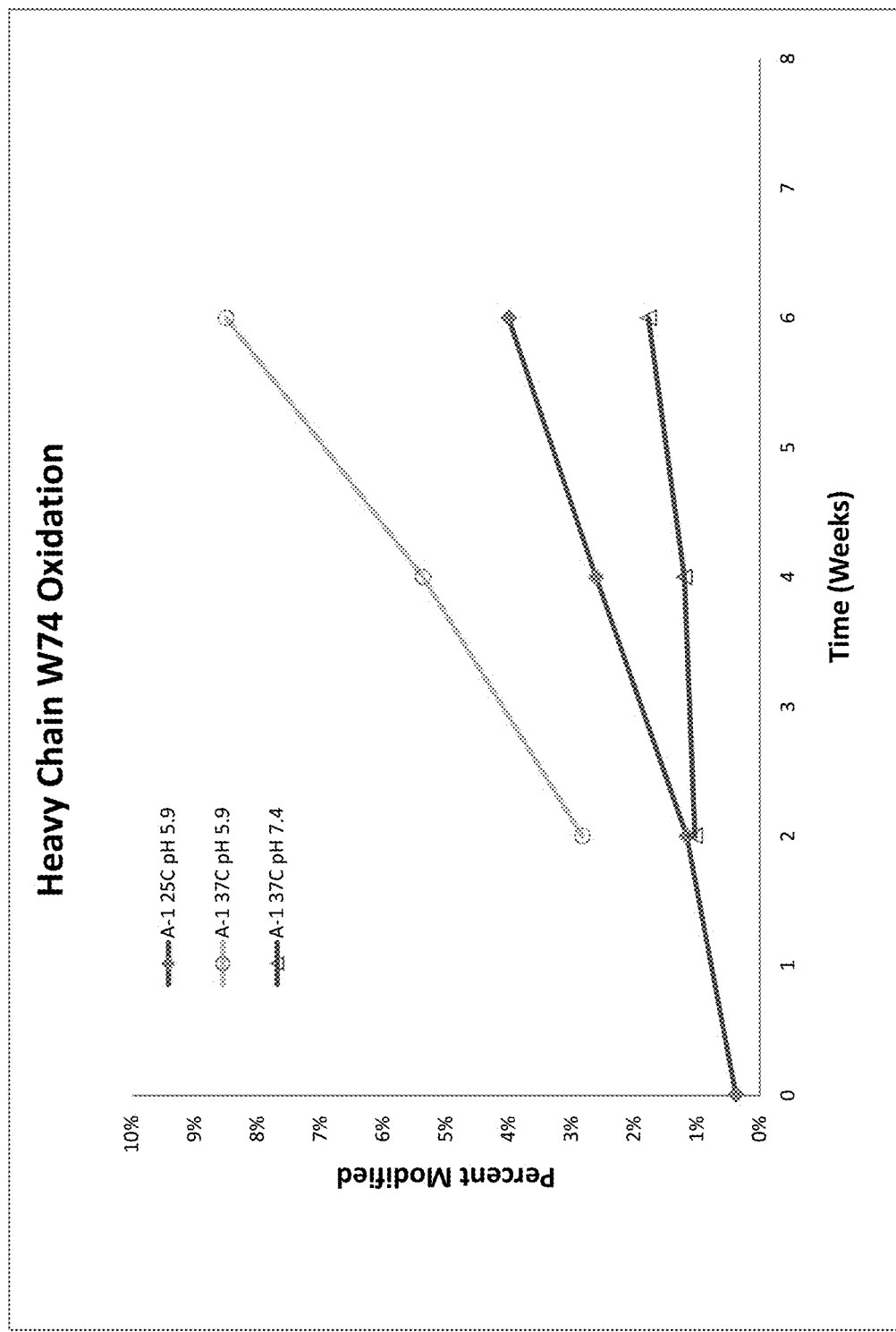
FIG. 2 illustrates kinetics of W74a oxidation over time as measured in the stress panel. Diamond: Antibody A-1, 25° C., pH 5.9. Open circle: Antibody A-1, 37° C., pH 5.9. Open triangle: Antibody A-1, 37° C., pH 7.4. The degree of oxidation in greatest in the pH 5.9 sample stressed at 37° C. for 6 weeks, suggesting that W74a oxidation may be the source of potency loss observed in this condition. In addition to the significant oxidation at heavy chain W74a observed in pH 5.9 conditions, a steady percentage of deamidation at light chain position N26 was observed on the constructs coming out of cell culture and increased further at pH 7.4 incubation conditions.

In some embodiments, the variable heavy chain of any of the anti-gp120 antibodies of this disclosure is linked to a heavy chain constant region comprising a CH1 domain and a hinge region. In some embodiments, the variable heavy chain of any of the anti-gp120 antibodies of this disclosure is linked to a heavy chain constant region comprising a CH3 domain. In certain embodiments, the variable heavy chain of any of the anti-gp120 antibodies of this disclosure is linked to a heavy chain constant region comprising a CH1 domain, hinge region, and CH2 domain from IgG4 and a CH3 domain (e.g., from IgG1, IgG2, IgG3, or IgG4). In some instances, the variable heavy chain of any of the anti-gp120 antibodies of this disclosure is linked to a heavy chain constant region comprising a CH1 domain, hinge region, CH2 domain, and a CH3 domain from IgG1, IgG2, IgG3, or IgG4. In certain embodiments, the variable heavy chain of any of the anti-gp120 antibodies of this disclosure is linked to a heavy chain constant region comprising a CH1 domain, CH2 domain, and a CH3 domain from IgG1 (e.g., human IgG1, e.g., IgG1m3 allotype) and an IgG3 hinge region (e.g., an "open" IgG3 hinge region designated "IgG3 C-" in WO 2017/096221 (see, e.g., FIG. 2A of this PCT publication)). This IgG3 hinge region is expected to exhibit improved Fab arm flexibility and the ability to span over a 200A° distance that is sufficient for intra-trimeric interactions. In certain embodiments, such a chimeric antibody contains one or more additional mutations in the heavy chain constant region that increase the stability of the chimeric antibody. In certain embodiments, the heavy chain constant region includes substitutions that modify the properties of the antibody (e.g., increase effector function, improve pharmacokinetics, increase or decrease Fc receptor binding, increase or decrease antibody glycosylation, increase or decrease binding to C1q, increase half-life).

In certain embodiments, the anti-gp120 antibody is an IgG antibody (e.g., IgG1, IgG2, IgG3, IgG4). In one embodiment, the antibody is human IgG1. In another embodiment, the antibody is human IgG2. In some embodiments, the antibody has a chimeric heavy chain constant region (e.g., having the CH1, hinge, and CH2 regions of human IgG4 and CH3 region of human IgG1). In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively, and the antibody is human IgG1. In certain embodiments, the anti-gp120 antibodies or gp120-binding fragments have a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278, and the antibody is human IgG1.

IgG antibodies exist in various allotypes and isoallotypes. In certain embodiments, antibodies of the present disclosure include an IgG1 heavy chain having an allotype of G1m1; nG1m2; G1m3; G1m17,1; G1m17,1,2; G1m3,1; or G1m17. Each of these allotypes or isoallotypes is characterized by the following amino acid residues at the indicated positions within the IgG1 heavy chain constant region (Fc) (EU numbering): G1m1: D356, L358; nG1m1: E356, M358; G1m3: R214, E356, M358, A431; G1m17,1: K214, D356, L358, A431; G1m17,1,2: K214, D356, L358, G431; G1m3, 1: R214, D356, L358, A431; and G1m17: K214, E356, M358, A431. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively, and the antibody has an IgG1 heavy chain having an allotyple of G1m1; nG1m2; G1m3; G1m17,1; G1m17,1,2; G1m3,1; or G1m17. In certain embodiments, the anti-gp120 antibodies or gp120-binding fragments have a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278, and the antibody has an IgG1 heavy chain having an allotyple of G1m1; nG1m2; G1m3; G1m17,1; G1m17,1,2; G1m3,1; or G1m17.

In one embodiment, any of the VHs of an anti-gp120 antibody disclosed herein is directly linked to, or linked via an intervening amino acid sequence (e.g., a G-S linker), to a wild type IgG1m3 sequence provided below (representative allotype-determining residues are indicated in bold).

(SEQ ID NO: 347)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPGK.

In another embodiment, any of the VHs of an anti-gp120 antibody disclosed herein is directly linked to, or linked via an intervening amino acid sequence (e.g., a G-S linker), to a wild type IgG1m17 sequence provided below (representative allotype-determining residues are indicated in bold).
IgG1m17:

IgG1m17:
(SEQ ID NO: 348)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLGGPSVFLEPPKPKDTLMISRTPEVCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPGK.

In certain embodiments, a VH of an anti-gp120 antibody disclosed herein is directly linked to, or linked via an intervening amino acid sequence (e.g., a G-S linker), to a IgG1m17 sequence with 1 to 10 (e.g., 1, 2, 3, 4, 5, 6, 7, 8, 9, 10) amino acid substitutions in SEQ ID NO:348 (e.g., substitutions made to improve effector function and/or to increase half-life). Exemplary amino acid substitutions in the Fc region (of e.g., IgG1 such as IgG1m17) include S239D, I332E, G236A, A330L, M428L, N434S; S239D, I332E, G236A, A330L; S239D, I332E M428L, N434S; S239D, I332E, A330L, M428L, N434S; F243L, R292P, Y300L, V305I, P396L, M428L, N434S; and S239D, I332E, G236A, A330L.

In certain embodiments, the anti-gp120 antibody is a human IgG1/human kappa antibody. In some embodiments, antibodies of this disclosure comprise a kappa light chain having an allotype selected from Km1; Km1,2; or Km3. Each of these allotypes is characterized by the following amino acid residues at the indicated positions within the light chain (EU numbering): Km1: V153, L191; Km1,2: A153, L191; and Km3: A153, V191. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively and comprises a kappa light chain having an allotype selected from Km1; Km1,2; or Km3. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively and comprises a kappa light chain having an allotype Km3. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively and is a human IgG1/human kappa antibody, such as an human IgG1/Km3. In certain embodiments, the anti-gp120 antibodies or gp120-binding fragments have a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278, and is a human IgG1/human kappa antibody, such as an human IgG1/Km3.

In certain embodiments, an anti-gp120 antibody of this disclosure comprises a human kappa light chain comprising one of the following amino acid sequences, in which representative allotype-determining residues are indicated in bold:
Km1:

Km1:
(SEQ ID NO: 349)
RTVAAPSVFIFPPSDEQLKSGTASVVCLLNNFYPREAKVQWKVDNVLQSG

NSQESVTEQDSKDSTYSLSSTLTLSKADYEKHKLYACEVTHQGLSSPVTK

SFNRGEC;

Km1, 2:
(SEQ ID NO: 350)
RTVAAPSVFIFPPSDEQLKSGTASVVCLLNNFYPREAKVQWKVDNALQSG

NSQESVTEQDSKDSTYSLSSTLTLSKADYEKHKLYACEVTHQGLSSPVTK

SFNRGEC;
or

Km3:

(SEQ ID NO: 351)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.

In one embodiment, an anti-gp120 antibody of this disclosure comprises a human kappa light chain, Km3. In a specific embodiment, a VL of an anti-gp120 antibody disclosed herein is directly linked to, or linked via an intervening amino acid sequence (e.g., a G-S linker), to a wild type human Km3 sequence (SEQ ID NO:351). In certain embodiments, the VL of an anti-gp120 antibody disclosed herein is directly linked to, or linked via an intervening amino acid sequence (e.g., a G-S linker), to a mutant human Km3 sequence having 1 to 5 (i.e., 1, 2, 3, 4, 5) amino acid substitutions within SEQ ID NO:351.

In certain embodiments, the anti-gp120 antibody is a human IgG1/human lambda antibody. Each individual human includes between seven and eleven different lambda light chain genes, which encode light chains selected from Lambda1, Lambda2, Lambda3, Lambda4, Lambda5, Lambda6, and Lambda7. In certain embodiments, antibodies of the present disclosure comprise a lambda light chain selected from Lambda1, Lambda2, Lambda3, Lambda4, Lambda5, Lambda6, and Lambda7. In some embodiments, an antibody described herein comprises a lambda light chain comprising one of the following amino acid sequences, in which representative lambda-determining residues are indicated in bold:

Lambda1:

(SEQ ID NO: 352)
GQPKANPTVTLFPPSSEELQANKATLVCLISDFYPGAVTVAWKADGSPVK

AGVETTKPSKQSNNKYAASSYLSLTPEQWKSHRSYSCQVTHEGSTVEKTV

APTECS;

Lambda2:

(SEQ ID NO: 353)
GQPKAAPSVTLFPPSSEELQANKATLVCLISDFYPGAVTVAWKADSSPVK

AGVETTTPSKQSNNKYAASSYLSLTPEQWKSHRSYSCQVTHEGSTVEKTV

APTECS;

Lambda3:

(SEQ ID NO: 354)
GQPKAAPSVTLFPPSSEELQANKATLVCLISDFYPGAVIVAWKADSSPAK

AGVETTTPSKQSNNKYAASSYLSLTPEQWKSHKSYSCQVTHEGSTVEKTV

APTECS;
or

Lambda7:

(SEQ ID NO: 355)
GQPKAAPSVTLFPPSSEELQANKATLVCLVSDFYPGAVIVAWKADGSPVK

VGVETTKPSKQSNNKYAASSYLSLTPEQWKSHRSYSCRVTHEGSTVEKTV

APAECS.

In one embodiment, the anti-gp120 antibody is a human IgG1m17/human Km3 antibody. The constant regions (light and/or heavy) can include 1 to 10 (e.g., 1, 2, 3, 4, 5, 6, 7, 8, 9, 10) amino acid substitutions (e.g., substitutions made to improve effector function and/or to increase half-life). In some embodiments, the antibodies are afucosylated. In some embodiments, the antibodies comprise one or more tags. In certain embodiments, the one or more tags comprise an avidin tag. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively and is a human IgG1m17/human Km3 antibody. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively and is a human IgG1m17/human Km3 antibody, wherein the heavy chain constant region includes 1 to 10 amino acid substitutions. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively and is a human IgG1m17/human Km3 antibody, wherein the heavy chain constant region includes the following amino acid substitutions compared to SEQ ID NO: 348: S239D, I332E, G236A, A330L, M428L, N434S. In certain embodiments, the anti-gp120 antibodies or gp120-binding fragments have a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278, and is a human IgG1/human kappa antibody, such as an human IgG1/Km3, wherein the heavy chain constant region includes the following amino acid substitutions compared to SEQ ID NO: 348: S239D, I332E, G236A, A330L, M428L, N434S. In certain embodiments, these substitutions improve effector function. In certain embodiments, these substitutions increase half-life. In certain embodiments, these substitutions improve effector function and improve half-life.

In certain embodiments, the antibody that binds to gp120 comprises an amino acid sequence of a VH of an anti-gp120 antibody disclosed herein and of a VL of an anti-gp120 antibody disclosed herein. Exemplary VH and VL amino acid sequences of an anti-gp120 antibody include the sequences set forth in SEQ ID NOs: 182 and 223, respectively; SEQ ID NOs: 182 and 275, respectively; SEQ ID NOs: 182 and 278, respectively; SEQ ID NOs.: 182 and 292, respectively; SEQ ID NOs: 220 and 276, respectively; SEQ ID NOs: 465 and 276, respectively; SEQ ID NOs: 466 and 276, respectively; SEQ ID NOs: 182 and 491, respectively; SEQ ID NOs: 465 and 491, respectively; SEQ ID NOs.: 466 and 491, respectively; SEQ ID NOs: 182 and 493, respectively; SEQ ID NOs: 182 and 516, respectively; SEQ ID NOs: 182 and 276, respectively; SEQ ID NOs: 182 and 569, respectively; SEQ ID NOs: 477 and 223, respectively; SEQ ID NOs: 477 and 278, respectively; SEQ ID NOs: 477 and 292, respectively; and SEQ ID NOs: 478 and 276, respectively. In certain embodiments, the antibody comprises a VH and VL comprising the amino acid sequences set forth in: SEQ ID NOs.: 477 and 278, respectively. In certain embodiments, each of these antibodies are human IgG1m17/human Km3 antibodies. In certain embodiments, these antibodies comprise the amino acid sequence set forth in SEQ ID NO: 348 and/or 351. In some instances, these antibodies include up to 10 (e.g., 1, 2, 3, 4, 5, 6, 7, 8, 9, 10) amino acid substitutions (e.g., substitutions made to improve effector function and/or to increase half-life) within SEQ ID NO:

348 and/or 351, respectively. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively, and comprises the amino acid sequence set forth in SEQ ID NOs: 348 and 351 with 1 to 10 amino acid sequence substitutions within SEQ ID NO: 348 and/or 351. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively, and comprises the amino acid sequence set forth in SEQ ID NOs: 348 and 351 with 1 to 10 amino acid sequence substitutions within SEQ ID NO: 348. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively, and comprises the amino acid sequence set forth in SEQ ID NOs: 348 and 351, with the following amino acid substitutions in SEQ ID NO: 348: S239D, I332E, G236A, A330L, M428L, N434S. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively, and is a IgGm17/human Km3 antibody. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively, and the antibody comprises a human kappa light chain comprising the amino acid sequence set forth in SEQ ID NO: 351 and a IgG1 heavy chain having an allotype with the amino acid sequence set forth in SEQ ID NO: 348. In certain embodiments, the antibody comprises a VH and VL comprising the amino acid sequences set forth in: SEQ ID NOs.: 477 and 278, respectively, and comprises the amino acid sequence set forth in SEQ ID NOs: 348 and 351 with 1 to 10 amino acid sequence substitutions within SEQ ID NO: 348 and/or 351. In certain embodiments, the antibody comprises a VH and VL comprising the amino acid sequences set forth in: SEQ ID NOs.: 477 and 278, respectively, and comprises the amino acid sequence set forth in SEQ ID NOs: 348 and 351 with 1 to 10 amino acid sequence substitutions within SEQ ID NO: 348. In certain embodiments, the antibody comprises a VH and VL comprising the amino acid sequences set forth in: SEQ ID NOs.: 477 and 278, respectively, and comprises the amino acid sequence set forth in SEQ ID NOs: 348 and 351, with the following amino acid substitutions in SEQ ID NO: 348: S239D, I332E, G236A, A330L, M428L, N434S. In certain embodiments, the antibody comprises a VH and VL comprising the amino acid sequences set forth in: SEQ ID NOs.: 477 and 278, respectively, and is a IgGm17/human Km3 antibody. In certain embodiments, the antibody comprises a VH and VL comprising the amino acid sequences set forth in: SEQ ID NOs.: 477 and 278, respectively, and the antibody comprises a human kappa light chain comprising the amino acid sequence set forth in SEQ ID NO: 351 and a IgG1 heavy chain having an allotype with the amino acid sequence set forth in SEQ ID NO: 348.

In certain embodiments, the antibody that binds to gp120 comprises an amino acid sequence of a heavy chain of an anti-gp120 antibody disclosed herein and a light chain of an anti-gp120 antibody disclosed herein. Exemplary heavy chain and light chain sequences of an anti-gp120 antibody include the sequences set forth in SEQ ID NOs: 2 and 49, respectively; SEQ ID NOs: 2 and 100, respectively; SEQ ID NOs: 42 and 101, respectively; SEQ ID NOs: 2 and 103, respectively; SEQ ID NOs: 517 and 101, respectively; SEQ ID NOs: 518 and 101, respectively; SEQ ID NOs: 2 and 542, respectively; SEQ ID NOs: 517 and 542, respectively; SEQ ID NOs: 2 and 117, respectively; SEQ ID NOs: 518 and 542, respectively; SEQ ID NOs: 2 and 544, respectively; SEQ ID NOs: 2 and 567, respectively; SEQ ID NOs: 2 and 568, respectively; SEQ ID NOs: 529 and 49, respectively; SEQ ID NOs: 529 and 103, respectively; SEQ ID NOs: 529 and 117, respectively; and SEQ ID NOs: 530 and 101, respectively. In certain embodiments, the antibody that binds to gp120 comprises a heavy chain with the amino acid sequence set forth in SEQ ID NO: 529 and a light chain with the amino acid sequence set forth in SEQ ID NO: 103.

Antibodies or antigen-binding fragments described herein can be made, for example, by preparing and expressing nucleic acids that encode the amino acid sequences of the antibody.

Multispecific Antibodies

In another aspect, this disclosure provides multispecific antibodies. Multispecific antibodies are antibodies which binds two or more different epitopes (e.g., bispecific antibodies, trivalent antibodies, tetravalent antibodies). The anti-gp120 antibodies described above can be comprised as part of multispecific antibodies. The multispecific antibodies may have binding sites to at least one other antigen or one other epitope that is not bound by the anti-gp120 antibody binding site of the multispecific antibody. The anti-gp120 comprising multispecific antibody can include a dimerization domain and three or more (e.g., three, four, five, six) antigen binding sites. An exemplary dimerization domain comprises (or consists of) an Fc region. An anti-gp120 comprising multispecific antibody can comprise (or consist of) three to about eight (i.e., three, four, five, six, seven, eight) antigen binding sites. The multispecific antibody optionally comprises at least one polypeptide chain (e.g., two polypeptide chains, three polypeptide chains), wherein the polypeptide chain(s) comprise three or more variable domains. For instance, the polypeptide chain(s) may comprise, e.g., VD1-(X1)$_n$-VD2-(X2)$_n$-Fc, or VD1-(X1)$_n$-VD2-(X2)$_n$-VD3-(X3)$_n$-Fc, wherein VD1 is a first variable domain, VD2 is a second variable domain, VD3 is a third variable domain Fc is a polypeptide chain of an Fc region, X1, X2, and X3 represent an amino acid or peptide spacer, and n is 0 or 1. In certain instances, the variable domains may each be an scFv. Multispecific antibodies can be readily produced by recombinant expression of nucleic acid encoding the polypeptide chains of the antibody.

Bispecific Antibodies

In one aspect, the multispecific antibody is a bispecific antibody. Bispecific antibodies are antibodies that have binding specificities for two different epitopes. A bispecific antibody has two "arms." One arm of the bispecific antibody binds one epitope and the other arm another epitope. In one embodiment, one arm of the bispecific antibody binds a first antigen and the other arm of the bispecific antibody binds a second antigen. In another embodiment, the two arms of the bispecific antibody bind to two different epitopes of the same antigen (e.g., gp120).

In one aspect, this disclosure provides a bispecific antibody that specifically binds to gp120 and specifically binds to a second antigen. In certain embodiments, the second antigen is a triggering molecule on a leukocyte so as to focus and localize cellular defense mechanisms to the infected cell. In some cases, the second antigen is a T-cell receptor molecule (e.g., CD3, CD4); Fc receptors for IgG (FcγR), such as FcγRI (CD64), FcγRII (CD32), FcγRIII (CD16); CD89; an HIV-1 antigen (e.g., gp41); CCR5; a KIR family member, such as killer cell immunoglobulin like receptor, three Ig domains and long cytoplasmic tail 1 (KIR3DL1), killer cell immunoglobulin like receptor, three Ig domains and long cytoplasmic tail 1 (KIR3DL1), killer cell immunoglobulin like receptor, two Ig domains and long cytoplasmic tail 1 (KIR2DL1), killer cell immunoglobulin like receptor, two Ig domains and long cytoplasmic tail 2 (KIR2DL2), killer cell immunoglobulin like receptor, two Ig domains and long cytoplasmic tail 3 (KIR2DL3); an NKG2 family receptor such as, killer cell lectin like receptor C1 (KLRC1), killer cell lectin like receptor C2 (KLRC2), killer cell lectin like receptor C3 (KLRC3), killer cell lectin like receptor C4 (KLRC4), killer cell lectin like receptor D1 (KLRD1), killer cell lectin like receptor K1 (KLRK1); a natural cytotoxicity triggering receptor, such as natural cytotoxicity triggering receptor 3 (NCR3 or NKp30), natural cytotoxicity triggering receptor 2 (NCR2 or NK-p44), natural cytotoxicity triggering receptor 1 (NCR1 or NK-p46), CD226 (DNAM-1), cytotoxic and regulatory T cell molecule (CRTAM or CD355); a SLAM family member, such as signaling lymphocytic activation molecule family member 1 (SLAMF1), CD48 (SLAMF2), lymphocyte antigen 9 (LY9 or SLAMF3), CD244 (2B4 or SLAMF4), CD84 (SLAMF5), SLAM family member 6 (SLAMF6 or NTB-A), SLAM family member 7 (SLAMF7 or CRACC); CD27 (TNFRSF7), semaphorin 4D (SEMA4D or CD100), or CD160 (NK1). In certain embodiments, the second arm of the bispecific antibody binds a different epitope of gp120.

In a further embodiment, a bispecific antibody molecule of this disclosure includes a dual-variable-domain antibody (DVD-Ig), where each light chain and heavy chain contains two variable domains in tandem through a short peptide linkage (Wu et al., Generation and Characterization of a Dual Variable Domain Immunoglobulin (DVD-Ig™) Molecule, In: Antibody Engineering, Springer Berlin Heidelberg (2010)). In some embodiments, the bispecific antibody is a chemically-linked bispecific (Fab')2 fragment. In other embodiments, the bispecific antibody comprises a Tandab (i.e., a fusion of two single chain diabodies resulting in a tetravalent bispecific antibody that has two binding sites for each of the target antigens). In certain embodiments, the bispecific antibody is a flexibody, which is a combination of scFvs with a diabody resulting in a multivalent molecule. In yet another embodiment, the bispecific antibody comprises a "dock and lock" molecule, based on the "dimerization and docking domain" in Protein Kinase A, which, when applied to Fabs, can yield a trivalent bispecific binding protein consisting of two identical Fab fragments linked to a different Fab fragment. In another instance, the bispecific antibodies of this disclosure comprise a "Scorpion molecule," comprising, e.g., two scFvs fused to both termini of a human Fab-arm. In yet another embodiment, the bispecific antibody of this disclosure comprises a diabody.

Exemplary classes of bispecific antibodies include but are not limited to IgG-like molecules with complementary CH3 domains to force heterodimerization; IgG fusion molecules, wherein full length IgG antibodies are fused to extra Fab fragment or parts of Fab fragment; Fc fusion molecules, wherein single chain Fv molecules or stabilized diabodies are fused to heavy-chain constant-domains, Fc-regions or parts thereof; Fab fusion molecules, wherein different Fab-fragments are fused together; recombinant IgG-like dual targeting molecules, wherein the two sides of the molecule each contain the Fab fragment or part of the Fab fragment of at least two different antibodies; scFv- and diabody-based and heavy chain antibodies (e.g., domain antibodies, nanobodies) wherein different single chain Fv molecules or different diabodies or different heavy-chain antibodies (e.g. domain antibodies, nanobodies) are fused to each other or to another protein or carrier molecule.

Examples of Fab fusion bispecific antibodies include but are not limited to F(ab)$_2$ (Medarex/AMGEN), Dual-Action or Bis-Fab (Genentech), Dock-and-Lock (DNL) (Immunomedics), Bivalent Bispecific (Biotecnol) and Fab-Fv (UCB-Celltech). Examples of scFv-, diabody-based and domain antibodies include but are not limited to Bispecific T Cell Engager (BITE) (Micromet, Tandem Diabody (Tandab) (Affimed), Dual Affinity Retargeting Technology (DART) (MacroGenics), Single-chain Diabody (Academic), TCR-like Antibodies (AIT, ReceptorLogics), Human Serum Albumin ScFv Fusion (Merrimack) and COMBODY (Epigen Biotech), dual targeting nanobodies (Ablynx), and dual targeting heavy chain only domain antibodies.

Antigen-Binding Fragments

This disclosure encompasses antigen-binding fragments of the anti-gp120 antibodies disclosed herein. Antigen-binding antibody fragments (e.g., scFv, sc(Fv)$_2$, Fab, F(ab)$_2$, Fab', F(ab')$_2$, Facb, and Fv) may be prepared, e.g., by recombinant methods or by proteolytic digestion of intact antibodies. For example, antibody fragments can be obtained by treating the whole antibody with an enzyme such as papain, pepsin, or plasmin. Papain digestion of whole antibodies produces F(ab)$_2$ or Fab fragments; pepsin digestion of whole antibodies yields F(ab')$_2$ or Fab'; and plasmin digestion of whole antibodies yields Facb fragments.

Alternatively, antibody fragments can be produced recombinantly. For example, nucleic acids encoding the antibody fragments of interest can be constructed, introduced into an expression vector, and expressed in suitable host cells. See, e.g., Co, M. S. et al., *J. Immunol.*, 152:2968-2976 (1994); Better, M. and Horwitz, A. H., *Methods in Enzymology*, 178:476-496 (1989); Plueckthun, A. and Skerra, A., *Methods in Enzymology*, 178:476-496 (1989); Lamoyi, E., *Methods in Enzymology*, 121:652-663 (1989); Rousseaux, J. et al., *Methods in Enzymology*, (1989) 121: 663-669 (1989); and Bird, R. E. et al., *TIBTECH*, 9:132-137 (1991)). Antibody fragments can be expressed in and secreted from *E. coli*, thus allowing the facile production of large amounts of these fragments. Antibody fragments can be isolated from the antibody phage libraries. Alternatively, Fab'-SH fragments can be directly recovered from *E. coli* and chemically coupled to form F(ab)$_2$ fragments (Carter et al., *Bio/Technology*, 10:163-167 (1992)). According to another approach, F(ab')$_2$ fragments can be isolated directly from recombinant host cell culture. Fab and F(ab')$_2$ fragment with increased in vivo half-life comprising a salvage receptor binding epitope residues are described in U.S. Pat. No. 5,869,046.

Minibodies

Also encompassed by this disclosure are minibodies that bind gp120. Minibodies include diabodies, single chain (scFv), and single-chain (Fv)$_2$ (sc(Fv)$_2$).

A "diabody" is a bivalent minibody constructed by gene fusion (see, e.g., Holliger, P. et al., *Proc. Natl. Acad. Sci. U.S.A*, 90:6444-6448 (1993); EP 404,097; WO 93/11161). Diabodies are dimers composed of two polypeptide chains. The VL and VH domain of each polypeptide chain of the diabody are bound by linkers. The number of amino acid residues that constitute a linker can be between 2 to 12 residues (e.g., 3-10 residues or five or about five residues).

The linkers of the polypeptides in a diabody are typically too short to allow the VL and VH to bind to each other. Thus, the VL and VH encoded in the same polypeptide chain cannot form a single-chain variable region fragment, but instead form a dimer with a different single-chain variable region fragment. As a result, a diabody has two antigen-binding sites.

An scFv is a single-chain polypeptide antibody obtained by linking the VH and VL with a linker (see e.g., Huston et al., *Proc. Natl. Acad. Sci. U.S.A*, 85:5879-5883 (1988); and Plickthun, "The Pharmacology of Monoclonal Antibodies" Vol. 113, Ed Resenburg and Moore, Springer Verlag, New York, pp. 269-315, (1994)). The order of VHs and VLs to be linked is not particularly limited, and they may be arranged in any order. Examples of arrangements include: [VH] linker [VL]; or [VL] linker [VH]. The H chain V region and L chain V region in an scFv may be derived from any anti-gp120 antibody or antigen-binding fragment thereof described herein.

An sc(Fv)$_2$ is a minibody in which two VHs and two VLs are linked by a linker to form a single chain (Hudson, et al., *J. Immunol. Methods*, (1999), 231: 177-189). An sc(Fv)$_2$ can be prepared, for example, by connecting scFvs with a linker. The sc(Fv)$_2$ of the present disclosure include antibodies preferably in which two VHs and two VLs are arranged in the order of: VH, VL, VH, and VL ([VH] linker [VL] linker [VH] linker [VL]), beginning from the N terminus of a single-chain polypeptide; however the order of the two VHs and two VLs is not limited to the above arrangement, and they may be arranged in any order. Examples of arrangements are listed below:

[VL] linker [VH] linker [VH] linker [VL]
[VH] linker [VL] linker [VL] linker [VH]
[VH] linker [VH] linker [VL] linker [VL]
[VL] linker [VL] linker [VH] linker [VH]
[VL] linker [VH] linker [VL] linker [VH]

Normally, three linkers are required when four antibody variable regions are linked; the linkers used may be identical or different. There is no particular limitation on the linkers that link the VH and VL regions of the minibodies. In some embodiments, the linker is a peptide linker. Any arbitrary single-chain peptide comprising about three to 25 residues (e.g., 5, 6, 7, 8, 9, 10, 11, 12, 13, 14, 15, 16, 17, 18) can be used as a linker. Examples of such peptide linkers include: Ser; Gly Ser; Gly Gly Ser; Ser Gly Gly; Gly Gly Gly Ser (SEQ ID NO: 427); Ser Gly Gly Gly (SEQ ID NO: 428); Gly Gly Gly Gly Ser (SEQ ID NO: 429); Ser Gly Gly Gly Gly (SEQ ID NO: 430); Gly Gly Gly Gly Gly Ser (SEQ ID NO: 431); Ser Gly Gly Gly Gly Gly (SEQ ID NO: 432); Gly Gly Gly Gly Gly Gly Ser (SEQ ID NO: 433); Ser Gly Gly Gly Gly Gly Gly (SEQ ID NO: 434); (Gly Gly Gly Gly Ser)$_n$ (SEQ ID NO: 435), wherein n is an integer of one or more; and (Ser Gly Gly Gly Gly)$_n$ (SEQ ID NO: 436), wherein n is an integer of one or more.

In certain embodiments, the linker is a synthetic compound linker (chemical cross-linking agent). Examples of cross-linking agents that are available on the market include N-hydroxysuccinimide (NETS), disuccinimidylsuberate (DSS), bis(sulfosuccinimidyl)suberate (BS3), dithiobis(succinimidylpropionate) (DSP), dithiobis(sulfosuccinimidylpropionate) (DTSSP), ethyleneglycol bis(succinimidylsuccinate) (EGS), ethyleneglycol bis(sulfosuccinimidylsuccinate) (sulfo-EGS), disuccinimidyl tartrate (DST), di sulfosuccinimidyl tartrate (sulfo-DST), bis[2-(succinimidooxycarbonyloxy)ethyl]sulfone (BSOCOES), and bis[2-(sulfosuccinimidooxycarbonyloxy)ethyl] sulfone (sulfo-BSOCOES).

The amino acid sequence of the VH or VL in the minibodies may include modifications such as substitutions, deletions, additions, and/or insertions. For example, the modification may be in one or more of the CDRs of the anti-gp120 antibody or antigen-binding fragment thereof. In certain embodiments, the modification involves one, two, or three amino acid substitutions in one or more CDRs of the VH and/or VL domain of the anti-gp120 minibody. Such substitutions are made to improve the binding and/or functional activity of the anti-gp120 minibody. In other embodiments, one, two, or three amino acids of the CDRs of the anti-gp120 antibody or antigen-binding fragment thereof may be deleted or added as long as there is gp120 binding and/or functional activity when VH and VL are associated.

In some embodiments, the antibodies and antigen-binding fragments thereof, described herein, do not comprise a signal peptide. In some embodiments, the antibodies and antigen-binding fragments thereof, described herein, comprise an N-terminal signal peptide. The signal peptide can be an endogenous signal peptide (e.g., from a native or wild-type immunoglobulin protein), or from a heterologous polypeptide (e.g., a non-immunoglobulin protein). In some embodiments, the heterologous signal peptide is from a secreted protein, e.g., a serum protein, an immunoglobulin or a cytokine. In some embodiments, the signal peptide is from a serum albumin signal peptide (e.g., having the amino acid sequence KWVTFISLLFLFSSAYS (SEQ ID NO: 620). In some embodiments, the signal peptide is comprises a sequence selected from the group consisting of MDPKGSLSWRILLFLSLAFELSYG (SEQ ID NO: 621), MSVPTQVLGLLLLWLTDARC (SEQ ID NO: 622), METDTLLLWVLLLWVPGSTG (SEQ ID NO: 623), MKWVTFISLLFLFSSAYS (SEQ ID NO: 624), MRCLAEFLGLLVLWIPGAIG (SEQ ID NO: 625), and MDPKGSLSWRILLFLSLAFELSYG (SEQ ID NO: 626). The signal peptide can be designed to be cleaved off, e.g., after secretion from the cell, to form a mature fusion protein. A modified human serum albumin signal peptide to secrete proteins in cells that can find use in expressing the present fusion proteins is described, e.g., in Attallah, et al., *Protein Expr Purif.* (2017) 132:27-33. Additional guidance for selection of signal peptide sequences for use in expressing the herein described antibodies and antigen-binding fragments thereof are described, e.g., in Kober, et al., *Biotechnol Bioeng.* (2013) 110(4):1164-73; Gibson, et al., *Biotechnol Bioeng.* 2017 September; 114(9):1970-1977; Lin, et al., *Biotechnol J.* 2017 September; 12(9). doi: 10.1002/biot.201700268 (PMID 28727292); Ramezani, et al., *Protein Expr Purif.* 2017 July; 135:24-32; and Haryadi, et al., *PLoS One.* 2015 Feb. 23; 10(2):e0116878. As appropriate, the heavy chain and the light chain, or antigen-binding fragments thereof, can have the same or different signal peptides when expressed as individual proteins.

Fc Modifications

In certain embodiments, the antibodies of this disclosure include one or more amino acid sequence modifications in the heavy chain constant region (Fc) as compared to the IgG1m17 amino acid sequence (i.e., SEQ ID NO: 348). In certain embodiments, the antibodies of this disclosure include one or more amino acid sequence modifications in the heavy chain constant region (Fc) as compared to other anti-HIV-antibodies such as Antibody A or Antibody B. In some embodiments, these modifications increase stability or increase binding affinity of the modified antibody as compared to Antibody A or Antibody B. In certain embodiments, these modifications increase stability or increase effector function of the modified antibody as compared to Antibody A or Antibody B. In some embodiments, certain of these modifications, improve the pharmacokinetics of the antibody as compared to Antibody A or Antibody B. In certain embodiments, certain of these modifications, increase half-life of the antibody as compared to Antibody A or Antibody B. In other embodiments, certain of these modifications, increase antibody effector function and improve the pharmacokinetics of the antibody as compared to Antibody A or Antibody B. In other embodiments, certain of these modifications, increase antibody effector function and increase half-life of the antibody as compared to the Antibody A or Antibody B. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively, and comprises a heavy chain constant region with one or more amino acid sequence modifications as compared to SEQ ID NO: 348. In certain embodiments, the anti-gp120 antibodies or gp120-binding fragments have a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278. In certain embodiments, the antibody comprises a VH and VL comprising the amino acid sequences set forth in: SEQ ID NOs.: 477 and 278, respectively, and comprises a heavy chain constant region with one or more amino acid sequence modifications as compared to SEQ ID NO: 348. In some embodiments, these substitutions improve effector function. In some embodiments, these substitutions increase half-life. In some embodiments, these substitutions improve effector function and increase half-life.

In certain embodiments, the one or more modifications are selected from the following Fc amino acid substitutions (EU numbering) or combinations thereof: L234F; L235E; G236A; S239D; F243L; D265E; D265A; S267E; H268F; R292P; N297Q; N297A; S298A; S324T; I332E; S239D; A330L; L234F; L235E; P331S; F243L; Y300L; V305I; P396L; S298A; E333A; K334A; E345R; L235V; F243L; R292P; Y300L; P396L; M428L; E430G; N434S; G236A, S267E, H268F, S324T, and I332E; G236A, S239D, and I332E; S239D, A330L, I332E; L234F, L235E, and P331S; F243L, R292P, Y300L, V305I, and P396L; G236A, H268F, S324T, and I332E; S239D, H268F, S324T, and I332E; S298A, E333A, and K334A; L235V, F243L, R292P, Y300L, and P396L; S239D, I332E; S239D, S298A, and I332E; G236A, S239D, I332E, M428L, and N434S; G236A, S239D, A330L, I332E, M428L, and N434S; S239D, I332E, G236A and A330L; M428L and N4343S; M428L, N434S; G236A, S239D, A330L, and I332E; and G236A and I332E. In certain embodiments, one, two, three, four, or more amino acid substitutions are introduced into a Fc region to alter (e.g., increase) the effector function of the antibody. For example, these substitutions are located at positions selected from the group consisting of amino acid residues 236, 239, 330 and 332 (according to EU numbering). These positions can be replaced with a different amino acid residue such that the antibody has an improved effector function. In certain embodiments, the antibody comprises a VH comprising VH CDRs 1-3 and a VL comprising VL CDRs 1-3, wherein the VH CDRs 1-3 and VL CDRs 1-3 have the sequences set forth in: SEQ ID NOs.: 137, 138, 139, 140, 141, and 142, respectively, and comprises a heavy chain constant region with the following modifications (EU numbering) compared to SEQ ID NO: 348: S239D, I332E, G236A, A330L, M428L, N434S. In certain embodiments, the anti-gp120 antibodies or gp120-binding fragments have a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278, and comprises a heavy chain constant region with the following modifications (EU numbering) compared to SEQ ID NO: 348: S239D, I332E, G236A, A330L, M428L, N434S. In certain embodiments, the antibody comprises a VH and VL comprising the amino acid sequences set forth in: SEQ ID NOs.: 477 and 278, respectively, and comprises a heavy chain constant region with the following modifications (EU numbering) compared to SEQ ID NO: 348: S239D, I332E, G236A, A330L, M428L, N434S. In some embodiments, these substitutions improve effector function. In some embodiments, these substitutions increase half-life. In some embodiments, these substitutions improve effector function and increase half-life.

In certain instances, the antibodies of the present application comprise mutations that increase or enhance effector function by enhancing the binding of the Fc to activating FcγRs. In some instances, the antibodies of the present application comprise mutations that increase the pharmacokinetic half-life of the antibody.

Mutations that increase the half-life of an antibody are known in the art. In one embodiment, the constant region of an antibody described herein comprises a methionine to tyrosine substitution at position 252 (EU numbering), a serine to threonine substitution at position 254 (EU numbering), and a threonine to glutamic acid substitution at position 256 9EU numbering). See, e.g., U.S. Pat. No. 7,658,921. This type of mutant, designated as a "YTE mutant" exhibits a four-fold increased half-life relative to wild-type versions of the same antibody (Dall'Acqua t al., *J Biol Chem*, 281: 23514-24 (2006); Robbie et al., *Antimicrob Agents Chemotherap.*, 57(12):6147-6153 (2013)). In certain embodiments, an antibody comprises an IgG constant domain comprising one, two, three or more amino acid substitutions of amino acid residues at positions 251-257, 285-290, 308-314, 385-389, and 428-436 (EU numbering). In other embodiments, an antibody described herein comprises T250Q and M428L (EU numbering) mutations. In other embodiments, an antibody described herein (e.g., Duobodies®) comprises H433K and N434F (EU numbering) mutations.

Conjugated Antibodies

Any of the antibodies disclosed herein may be conjugated antibodies which are bound to various molecules including macromolecular substances such as polymers (e.g., polyethylene glycol (PEG), polyethylenimine (PEI) modified with PEG (PEI-PEG), polyglutamic acid (PGA) (N-(2-Hydroxypropyl) methacrylamide (HPMA) copolymers), hyaluronic acid, radioactive materials (e.g., $^{90}$Y, $^{131}$I, $^{125}$I, $^{35}$S, $^{3}$H, $^{121}$In, $^{99}$Tc), fluorescent substances (e.g., fluorescein and rhodamine), luminescent substances (e.g., luminol), Qdots, haptens, enzymes (e.g., glucose oxidase), metal chelates, biotin, avidin, and drugs.

In some embodiments, the antibodies or antigen-binding fragments thereof described herein are conjugated is conjugated to a cytotoxic agent, e.g., for delivery to and killing of an HIV infected cell. In various embodiments, the cytotoxic agent is a small organic compound or an inhibitory nucleic acid, e.g., a short-inhibitory RNA (siRNA), a microRNA (miRNA). In some embodiments, the antibodies or antigen-binding fragments thereof described herein are conjugated to a cytotoxic agent selected from the group consisting of monomethyl auristatin E (MMAE), monomethyl auristatin F (MMAF), a calicheamicin, ansamitocin, maytansine or an analog thereof (e.g., mertansine/emtansine (DM1), ravtansine/soravtansine (DM4)), an anthracycline (e.g., doxorubicin, daunorubicin, epirubicin, idarubicin), pyrrolobenzodiazepine (PBD) DNA cross-linking agent SC-DR002 (D6.5), duocarmycin, a microtubule inhibitors (MTI) (e.g., a taxane, a vinca alkaloid, an epothilone), a pyrrolobenzodiazepine (PBD) or dimer thereof, a duocarmycin (A, B1, B2, C1, C2, D, SA, CC-1065), and a *Pseudomonas* exotoxin.

The above-described conjugated antibodies can be prepared by performing chemical modifications on the antibodies or the lower molecular weight forms thereof described herein. Methods for modifying antibodies are well known in the art (e.g., U.S. Pat. Nos. 5,057,313 and 5,156,840).

Nucleic Acids

This disclosure also provides a polynucleotide or polynucleotides encoding an antibody or antigen-binding fragment described herein, vectors comprising such polynucleotides, and host cells (e.g., mammalian cells including hamster cells or human cells, plant cells, yeast cells, bacterial cells, including *E. coli* cells) comprising such polynucleotides or expression vectors. Provided herein are polynucleotides comprising nucleotide sequence(s) encoding any of the antibodies provided herein, as well as vector(s) comprising such polynucleotide sequences, e.g., expression vectors for their efficient expression in host cells, e.g., mammalian cells.

In another aspect, this disclosure provides polynucleotides or nucleic acid molecules encoding an antibody or antigen-binding fragment thereof according to the present invention. In some embodiments, the nucleic acid molecules encode an antibody light chain (or a fragment thereof) or an antibody light chain (or a fragment thereof), or both of the present application. In other embodiments, the nucleic acid is a DNA, a cDNA, or an mRNA. In some other embodiments, the nucleic acid molecule is codon-optimized to enhance expression in a host cell.

In one aspect, this disclosure provides polynucleotides comprising nucleotide sequences encoding the VH, VL, or VH and VL of the antibodies or antigen-binding fragments which bind to gp120. In certain instances, the VH and VL have the amino acids set forth respectively in SEQ ID NOs.: 182 and 275; 182 and 278; 182 and 279; 182 and 280; 182 and 281; 182 and 282; 182 and 292; 182 and 304; 182 and 307; 182 and 309; 220 and 310; or 220 and 311.

In another aspect, provided herein are polynucleotides comprising a nucleotide sequence encoding the CDRs, light chain, or heavy chain of an antibody described herein. The polynucleotides can comprise nucleotide sequences encoding a light chain or light chain variable domain comprising the VL CDRs of antibodies described herein (see, e.g., Tables above). The polynucleotides can comprise nucleotide sequences encoding a heavy chain or heavy chain variable domain comprising the VH CDRs of antibodies described herein (see, e.g., Tables above). In one embodiment, a polynucleotide described herein encodes a variable light chain or light chain with the VL-CDRs comprising the amino acid sequence set forth in SEQ ID NOs: 140, 141, and 142, respectively. In another embodiment, a polynucleotide described herein encodes a variable heavy chain or heavy chain with VH CDRs comprising the amino acid sequence set forth in SEQ ID NOs: 137, 138, and 139, respectively. In one embodiment, a polynucleotide described herein encodes a VL domain comprising the amino acid sequence set forth in SEQ ID NO:275, 278, 279, 280, 281, 282, 292, 304, 307, 309, 310 or 311. In another embodiment, a polynucleotide described herein encodes a VH domain comprising the amino acid sequence set forth in SEQ ID NO:182 or 220. In yet another embodiment, a polynucleotide described herein encodes a light chain comprising the amino acid sequence set forth in SEQ ID NO:49, 100, 101, 103, 104, 105, 106, 107, 117, 129, 132, 134, 135, or 136. In another embodiment, a polynucleotide described herein encodes a heavy chain comprising the amino acid sequence set forth in SEQ ID NO: 2 or 42. In one embodiment, a polynucleotide described herein encodes a VL domain comprising the amino acid sequence set forth in SEQ ID NO: 278. In another embodiment, a polynucleotide described herein encodes a VH domain comprising the amino acid sequence set forth in SEQ ID NO: 477. In yet another embodiment, a polynucleotide described herein encodes a light chain comprising the amino acid sequence set forth in SEQ ID NO: 103. In another embodiment, a polynucleotide described herein encodes a heavy chain comprising the amino acid sequence set forth in SEQ ID NO: 529.

In some embodiments, the nucleic acid or nucleic acids encode a VH selected from the group consisting of SEQ ID NOs: 181-221 and 465-478 and having at least 80%, at least 85%, at least 90%, at least 91%, at least 92%, at least 93%, at least 94%, at least 95%, at least 96%, at least 97%, at least 98%, at least 99%, or 100%, identical to a nucleic acid sequence selected from the group consisting of SEQ ID NOs: 572-581; and encode a VL selected from the group consisting of SEQ ID NOs: 222-311, 479-516 and 569 and having at least 80%, at least 85%, at least 90%, at least 91%, at least 92%, at least 93%, at least 94%, at least 95%, at least 96%, at least 97%, at least 98%, at least 99%, or 100%, identical to a nucleic acid sequence selected from the group consisting of SEQ ID NOs: 582-595.

In some embodiments, the nucleic acid or nucleic acids encode a HC selected from the group consisting of SEQ ID NOs: 1-47 and 517-530 and having at least 80%, at least 85%, at least 90%, at least 91%, at least 92%, at least 93%, at least 94%, at least 95%, at least 96%, at least 97%, at least 98%, at least 99%, or 100%, identical to a nucleic acid sequence selected from the group consisting of SEQ ID NOs: 596-605; and encode a LC selected from the group consisting of SEQ ID NOs: 48-136 and 531-567 and having at least 80%, at least 85%, at least 90%, at least 91%, at least 92%, at least 93%, at least 94%, at least 95%, at least 96%, at least 97%, at least 98%, at least 99%, or 100%, identical to a nucleic acid sequence selected from the group consisting of SEQ ID NOs: 606-619.

In some embodiments, the nucleic acid molecule or molecules are codon-biased to enhance expression in a desired host cell, e.g., in human cells, mammalian cells, yeast cells, plant cells, insect cells, or bacterial cells, e.g., *E. coli* cells. Accordingly, provided are polynucleotides encoding an antibody or antigen-binding fragment, as described herein, wherein the polynucleotides are codon-biased, comprise replacement heterologous signal sequences, and/or have mRNA instability elements eliminated. Methods to generate codon-biased nucleic acids can be carried out by adapting the methods described in, e.g., U.S. Pat. Nos. 5,965,726; 6,174,666; 6,291,664; 6,414,132; and 6,794,498. Preferred codon usage for expression of the an antibody or antigen-binding fragments in desired host cells is provided, e.g., at kazusa.or.jp/codon/; and genscript.com/tools/codon-frequency-table.

Illustrative polynucleotides encoding the VH and the VL of the anti-gp120 antibodies and antigen-binding fragments described herein, codon-biased for improved expression an a mammalian host cell, are provided in Tables XII and XIII Illustrative polynucleotides encoding the HC and the LC of the anti-gp120 antibodies and antigen-binding fragments described herein, codon-biased for improved expression an a mammalian host cell, are provided in Tables XIV and XV.

As appropriate, in certain embodiments, the 3'-end of the polynucleotide or polynucleotides encoding the antibodies or antigen-binding fragments described herein, comprise multiple tandem stop codons, e.g., two or more tandem TAG ("amber"), TAA ("ochre") or TGA ("opal" or "umber") stop codons. The multiple tandem stop codons can be the same or different. In embodiments where the polynucleotide is an mRNA, the 3'-end of the polynucleotide can comprise a poly-A tail.

Also encompassed by this disclosure are polynucleotides encoding an anti-gp120 antibody or antigen-binding fragment thereof, an anti-CD3 antibody or antigen-binding fragment thereof, an anti-CD16 antibody or antigen-binding fragment thereof, or an anti-CD89 antibody or antigen-binding fragment thereof that are optimized, e.g., by codon optimization, replacement with heterologous signal sequences, and elimination of mRNA instability elements. Methods to generate optimized nucleic acids can be carried out by adapting the methods described in, e.g., U.S. Pat. Nos. 5,965,726; 6,174,666; 6,291,664; 6,414,132; and 6,794,498.

In some embodiments, the one or more polynucleotides encoding the antibodies or antigen-binding fragments, described herein, are formulated or encapsulated in a lipid nanoparticle (LNP). As used herein, the term "lipid nanoparticle" refers to one or more spherical nanoparticles with an average diameter of between about 10 to about 1000 nanometers, and which comprise a solid lipid core matrix that can solubilize lipophilic molecules. In certain embodiments, the lipid core is stabilized by surfactants (e.g., emulsifiers), and can comprise one or more of triglycerides (e.g., tristearin), diglycerides (e.g., glycerol bahenate), monoglycerides (e.g., glycerol monostearate), fatty acids (e.g., stearic acid), steroids (e.g., cholesterol), and waxes (e.g., cetyl palmitate), including combinations thereof. Lipid nanoparticles are described, for example, in Petrilli et al., Curr Pharm Biotechnol. 15:847-55, 2014; and U.S. Pat. Nos. 6,217,912; 6,881,421; 7,402,573; 7,404,969; 7,550,441; 7,727,969; 8,003,621; 8,691,750; 8,871,509; 9,017,726; 9,173,853; 9,220,779; 9,227,917; and 9,278,130, each of which is incorporated by reference in its entirety. LNP-encapsulated mRNA molecules encoding a broadly neutralizing antibody are described, e.g., in Pardi, et al., Nat Commun. (2017) 8:14630. In certain embodiments, the one or more polynucleotides encoding the antibodies or antigen-binding fragments, described herein, are formulated or encapsulated in an LNP comprised of an ionizable cationic lipid/phosphatidylcholine/cholesterol/PEG-lipid, e.g., in molar ratios of about 50:10:38.5:1.5 mol mol$^{-1}$, respectively.

TABLE XII

POLYNUCLEOTIDES ENCODING HEAVY CHAIN VARIABLE REGIONS (VH)

| SEQ ID NO: | Polynucleotide sequence encoding VH |
|---|---|
| 572 | CAGGTGCAGTTGTTGCAGTCTGGCGCCGCTGTTACAAAGCCTGGCGCTTCTGTTAGAGTGTCCTGCGAGGCCTCCGGCTACAAC ATCAGAGACTACTTCATCCACTGGTGGCGGCAGGCTCCAGGACAGGGATTGCAATGGGTCGGATGGATCAACCCTAAGACCGGC CAGCCTAACAACCCTAGACAGTTCCAGGGCAGAGTGTCCCTGACCAGACACGCCTCTTGGGACTTCGACACCTTCAGCTTCTAC ATGGACCTGAAGGCCCTGAGATCCGACGATACCGCCGTGTACTTCTGCGCCAGACAGAGAAGCGACTACTGGGATTTCGATGTG TGGGGCTCTGGCACCCAAGTGACCGTGTCCTCT |
| 573 | CAGGTGCAGCTGCTGCAGTCTGGCGCCGCTGTGACAAAACCAGGCGCTTCTGTGCGGGTGTCCTGCGAGGCCAGCGGCTACAAC ATCCGGGACTACTTCATTCACTGGTGGCGCCAGGCCCCTGGACAGGGACTGCAGTGGGTGGGATGGATCAACCCCAAGACCGGC CAGCCCAACAACCCCAGACAGTTCCAGGGCAGAGTGTCCCTGACCAGACACGCCAGCTGGGACTTCGACACCTTCAGCTTCTAC ATGGACCTGAAGGCCCTGCGGAGCGACGATACCGCCGTGTACTTCTGCGCCAGACAGAGAAGCGACTACTGGGATTTCGACGTG TGGGGCAGCGGCACCCAAGTGACCGTGTCATCT |
| 574 | CAGGTGCAGTTGTTGCAGTCTGGCGCCGCTGTTACAAAGCCTGGCGCTTCTGTTAGAGTGTCCTGCGAGGCCTCCGGCTACAAC ATCAGAGACTACTTCATCCACTGGTGGCGGCAGGCTCCAGGACAGGGATTGCAATGGGTCGGATGGATCAACCCTAAGACCGGC CAGCCTAACAACCCTAGACAGTTCCAGGGCAGAGTGTCCCTGACCAGACACGCCTCTTTCGACTTCGACACCTTCAGCTTCTAC ATGGACCTGAAGGCCCTGAGATCCGACGATACCGCCGTGTACTTCTGCGCCAGACAGAGAAGCGACTACTGGGACTTCGATGTG TGGGGCTCTGGCACCCAAGTGACCGTGTCCTCT |
| 575 | CAGGTGCAGCTGCTGCAGTCTGGCGCCGCTGTGACAAAACCAGGCGCTTCTGTGCGGGTGTCCTGCGAGGCCAGCGGCTACAAC ATCCGGGACTACTTCATTCACTGGTGGCGCCAGGCCCCTGGACAGGGACTGCAGTGGGTGGGATGGATCAACCCCAAGACCGGC CAGCCCAACAACCCCAGACAGTTCCAGGGCAGAGTGTCCCTGACCAGACACGCCAGCTTCGACTTCGACACCTTCAGCTTCTAC ATGGACCTGAAGGCCCTGCGGAGCGACGATACCGCCGTGTACTTCTGCGCCAGACAGAGAAGCGACTACTGGGATTTCGACGTG TGGGGCAGCGGCACCCAAGTGACCGTGTCATCT |
| 576 | CAGGTCCACTTGTCTCAATCTGGCGCCGCTGTGACAAAGCCTGGCGCTTCTGTCAGAGTGTCTTGCGAGGCCTCTGGCTACAAG ATCCGGGACCACTTTATCCACTGGTGGCGACAGGCTCCAGGACAGGGATTGCAGTGGGTCGGATGGATCAACCCTAAGACCGGC CAGCCTAACAACCCTAGACAGTTCCAGGGCAGAGTGTCCCTGACCAGACACGCCTCTTGGGACTTCGACACCTTCAGCTTCTAC ATGGACCTGAAGGCCGTGCGGAGCGACGACACCGCTATCTACTTTTGCGCCAGACAGAGATCCGACTACTGGGATTTCGATGTG TGGGGCTCTGGCACCCAAGTGACCGTGTCCTCT |
| 577 | CAGGTCCACCTGTCTCAATCTGGCGCCGCTGTTACAAAACCAGGCGCCTCTGTTAGAGTGTCTTGCGAGGCCAGCGGCTACAAG ATCAGGGACCACTTTATTCACTGGTGGCGCCAGGCTCCAGGACAGGGACTTCAATGGGTCGGATGGATCAACCCTAAGACCGGC CAGCCTAACAACCCCAGACAGTTCCAGGGCAGAGTGTCTCTGACAAGACACGCCAGCTGGGACTTCGACACCTTCAGCTTCTAC ATGGACCTGAAGGCCGTGCGGAGCGACGACACCGCCATCTATTTTTGCGCCAGACAGAGAAGCGACTACTGGGATTTCGATGTG TGGGGCAGCGGCACCCAAGTGACAGTCTCTTCT |

TABLE XII-continued

POLYNUCLEOTIDES ENCODING HEAVY CHAIN VARIABLE REGIONS (VH)

SEQ
ID
NO: Polynucleotide sequence encoding VH

578 CAGGTCCACTTGTCTCAATCTGGCGCCGCTGTGACAAAGCCTGGCGCTTCTGTCAGAGTGTCTTGCGAGGCCTCTGGCTACAAG
    ATCCGGGACCACTTTATCCACTGGTGGCGACAGGCTCCAGGACAGGGATTGCAGTGGGTCGGATGGATCAACCCTAAGACCGGC
    CAGCCTAACAACCCTAGACAGTTCCAGGGCAGAGTGTCCCTGACCAGACACGCCTCTTTCGACTTCGACACCTTCAGCTTCTAC
    ATGGACCTGAAGGCCGTGCGGAGCGACGACACCGCTATCTACTTTTGCGCCAGACAGAGATCCGACTACTGGGACTTCGATGTG
    TGGGGCTCTGGCACCCAAGTGACCGTGTCCTCT

579 CAGGTCCACCTGTCTCAATCTGGCGCCGCTGTTACAAAACCAGGCGCCTCTGTTAGAGTGTCTTGCGAGGCCAGCGGCTACAAG
    ATCAGGGACCACTTTATTCACTGGTGGCGCCAGGCTCCAGGACAGGGACTTCAATGGGTCGGATGGATCAACCCTAAGACCGGC
    CAGCCTAACAACCCCAGACAGTTCCAGGGCAGAGTGTCTCTGACAAGACACGCCAGCTTCGACTTCGACACCTTCAGCTTCTAC
    ATGGACCTGAAGGCCGTGCGGAGCGACGACACCGCCATCTATTTTGCGCCAGACAGAGAAGCGACTACTGGGATTTCGATGTG
    TGGGGCAGCGGCACCCAAGTGACAGTCTCTTCT

580 CAGGTCCACTTGTCTCAATCTGGCGCCGCTGTGACAAAGCCTGGCGCTTCTGTCAGAGTGTCTTGCGAGGCCTCCGGCTACAAC
    ATCCGGGACTACTTTATCCACTGGTGGCGGCAGGCTCCAGGACAGGGATTGCAATGGGTCGGATGGATCAACCCTAAGACCGGC
    CAGCCTAACAACCCTAGACAGTTCCAGGGCAGAGTGTCCCTGACCAGACACGCCTCTTGGGACTTCGACACCTTCAGCTTCTAC
    ATGGACCTGAAGGCCGTGCGGAGCGACGACACCGCTATCTACTTTTGCGCCAGACAGAGATCCGACTACTGGGATTTCGATGTG
    TGGGGCTCTGGCACCCAAGTGACCGTGTCCTCT

581 CAGGTCCACCTGTCTCAATCTGGCGCCGCTGTTACAAAACCAGGCGCCTCTGTTAGAGTGTCTTGCGAGGCCAGCGGCTACAAC
    ATCCGGGACTACTTTATTCACTGGTGGCGCCAGGCTCCAGGACAGGGACTTCAATGGGTCGGATGGATCAACCCTAAGACCGGC
    CAGCCTAACAACCCCAGACAGTTCCAGGGCAGAGTGTCTCTGACAAGACACGCCAGCTGGGACTTCGACACCTTCAGCTTCTAC
    ATGGACCTGAAGGCCGTGCGGAGCGACGACACCGCCATCTATTTTGCGCCAGACAGAGAAGCGACTACTGGGATTTCGATGTG
    TGGGGCAGCGGCACCCAAGTGACAGTCTCTTCT

TABLE XIII

POLYNUCLEOTIDES ENCODING LIGHT CHAIN VARIABLE REGIONS (VL)

SEQ
ID
NO: Polynucleotide sequence encoding VL

582 GACATCCAGATGACCCAGAGCCCTTCCTCTTTATCCGCTAGCGTCGGCGATACCGTGACCATCACATGCCAAGCTAACGGCTAC
    CTCAACTGGTACCAGCAGCGGAGGGGAAAGGCCCCCAAGCTGCTGATCTACGACGGCTCCAAGCTGGAGAGGGGAGTGCCTTCC
    CGGTTCAGCGGAAGGAGGTGGGGACAAGAATACAATTTAACCATCAACAATTTACAGCCCGAGGACATCGCTACCTACTTCTGC
    CAAGTTTACGAGTTCGTGGTGCCCGGCACTCGTCTGGATCTGAAG

583 GACATCCAGATGACCCAGAGCCCTAGCAGCCTGAGCGCCAGCGTGGGCGATACCGTGACCATTACCTGCCAGGCCAACGGCTAC
    CTGAACTGGTATCAGCAGCGGAGAGGCAAGGCCCCCAAGCTGCTGATCTACGACGGCAGCAAGCTGGAAAGAGGCGTGCCCAGC
    AGATTCAGCGGCAGAAGATGGGGCCAGGAGTACAACCTGACCATCAACAACCTGCAGCCCGAGGATATCGCCACATACTTTTGC
    CAGGTGTACAGAGTTCGTGGTGCCCGGCACACGGCTGGACCTGAAA

584 GACATCCAGATGACCCAGTCTCCATCCTCTCTGTCTGCCTCTGTGGGCGATACCGCTACCATCACCTGTCAGGCCAACGGCTAC
    CTGAACTGGTATCAGCAGAGAAGAGGCAAGGCCCCTAAGCTGCTGATCTACGACGGCTCCAAACTGGAAAGAGGCGTGCCCTCT
    CGGTTCTCTGGCAGAAGATGGGGCCAAGAGTACAACCTGACCATCAACAACCTGCAGCCTGAGGATATCGCCACATACTTTTGC
    CAGGTGTACGAGTTCGTGGTGCCTGGCACAAGACTGGACCTGAAG

585 GATATTCAGATGACACAGAGCCCCAGTAGCCTGAGCGCCAGCGTGGGCGACACCGCAACCATCACCTGTCAGGCCAACGGCTAT
    CTGAACTGGTATCAACAGAGAGGGGCAAGGCCCCCAAGCTCCTGATATACGACGGCAGCAAGCTGGAGAGGGGCGTTCCCAGC
    CGCTTCAGCGGCAGGAGGTGGGCCAGGAGTACAACCTTACAATCAACAACCTGCAGCCCGAGGACATCGCCACCTATTTCTGC
    CAAGTTTACGAGTTCGTGGTGCCCGGCACCAGGCTGGACCTGAAG

586 GACATCCAGATGACCCAGTCTCCATCCTCTCTGTCTGCCTCTGTGGGCGACAGAGCTACCATCACCTGTCAGGCCAACGGCTAC
    CTGAACTGGTATCAGCAGAAGAGGCAAGGCCCCCAAGCTGCTGATCTACGACGGCTCCAAACTGGAAAGAGGCGTGCCCTCC
    AGATTCTCCGGCTCTAGATGGGGCCAAGAGTACAACCTGACCATCTCCAGCCTCCAGCCTGAGGATATCGCCACATACTTTTGC
    CAGGTGTACGAGTTCTTCGGCCCTGGCACCAGACTGGACCTGAAG

587 GATATTCAGATGACACAGAGCCCCAGTAGCCTGAGCGCCAGCGTGGGCGACAGAGCAACCATCACCTGTCAGGCCAACGGCTAT
    CTGAACTGGTATCAACAGAGAAGGGGCAAGGCCCCCAAGCTCCTGATATACGACGGCAGCAAGCTGGAGAGGGGCGTTCCCAGC
    CGCTTCAGCGGCTCAAGGTGGGGCCAGGAGTACAACCTTACAATCTCATCCCTGCAGCCCGAGGACATCGCCACCTATTTCTGC
    CAAGTTTACGAGTTCTTCGGACCCGGCACCAGGCTGGACCTGAAG

588 GACATCCAGATGACCCAGTCTCCATCCTCTCTGTCTGCCAGAGTGGGCGACACCGTGACAATCACCTGTCAGGCCAACGGCTAC
    CTGAACTGGTATCAGCAGAAGAGGCAAGGCCCCTAAGCTGCTGATCTACGACGGCTCCAAACTGGAAAGAGGCGTGCCCGCT
    AGATTCTCCGGCAGAAGATGGGGCCAAGAGTACAACCTGACCATCAACAACCTGCAGCCTGAGGACGTGGCCACATACTTTTGC
    CAGGTGTACGAGTTCATCGTGCCCGGCACCAGACTGGACCTGAAG

TABLE XIII-continued

POLYNUCLEOTIDES ENCODING LIGHT CHAIN VARIABLE REGIONS (VL)

SEQ
ID
NO: Polynucleotide sequence encoding VL

589 GATATTCAGATGACACAGAGCCCCAGTAGCCTGAGCGCCCGCGTGGGCGACACCGTGACCATCACCTGTCAGGCCAACGGCTAT
CTGAACTGGTATCAACAGAGGAGGGGCAAGGCCCCCAAGCTCCTGATATACGACGGCAGCAAGCTGGAGAGGGGCGTTCCCGCA
CGCTTCAGCGGCAGGAGGTGGGGCCAGGAGTACAACCTTACAATCAACAACCTGCAGCCCGAGGACGTCGCCACCTATTTCTGC
CAAGTTTACGAGTTCATCGTGCCCGGCACCAGGCTGGACCTGAAG

590 GACATCCAGATGACCCAGTCTCCATCCTCTCTGTCTGCCTCTGTGGGCGATACCGCTACCATCACCTGTCAGGCCAACGGCTAC
CTGAACTGGTATCAGCAGAGAAGAGGCAAGGCCCCTAAGCTGCTGATCTACGACGGCTCCAAACTGGAAAGAGGCGTGCCCTCT
CGGTTCTCTGGCAGAAGATGGGGCCAAGAGTACACCCTGACCATCAACAACCTGCAGCCTGAGGATATCGCCACATACTTTTGC
CAGGTGTACGAGTTCTTCGGCCCTGGCACCAGACTGGACCTGAAG

591 GACATCCAGATGACACAGAGCCCTAGCAGCCTGTCTGCCAGCGTGGGAGATACCGCCACAATTACCTGTCAGGCCAACGGCTAC
CTGAACTGGTATCAGCAGCGGAGAGGCAAGGCCCCTAAGCTGCTGATCTACGACGGCAGCAAGCTGGAAAGAGGCGTGCCCAGC
AGATTCAGCGGCAGAAGATGGGGCCAAGAGTACACCCTGACCATCAACAACCTGCAGCCTGAGGATATTGCCACATACTTTTGC
CAGGTGTACGAGTTCTTCGGCCCTGGCACCAGACTGGACCTGAAG

592 GACATCCAGATGACCCAGTCTCCATCCTCTCTGTCTGCCTCTGTGGGCGACAGAGCTACCATCACCTGTCAGGCCAACGGCTAC
CTGAACTGGTATCAGCAGAGAAGAGGCAAGGCCCCTAAGCTGCTGATCTACGACGGCTCCAAACTGGAAAGAGGCGTGCCCTCC
AGATTCTCCGGCTCTAGATGGGGCCAAGAGTACACCCTGACCATCTCTAGCCTGCAGCCTGAGGATATCGCCACATACTTTTGC
CAGGTGTACGAGTTCTTCGGCCCTGGCACCAGACTGGACCTGAAG

593 GACATCCAGATGACACAGAGCCCTAGCAGCCTGTCTGCCTCTGTGGGCGATAGAGCCACAATCACCTGTCAGGCCAACGGCTAC
CTGAACTGGTATCAGCAGAGAAGAGGCAAGGCCCCTAAGCTGCTGATCTACGACGGCAGCAAACTGGAAAGAGGCGTGCCAAGC
AGATTCAGCGGCTCTAGATGGGGCCAAGAGTACACCCTGACCATCTCTAGCCTGCAGCCTGAGGATATCGCCACATACTTTTGC
CAGGTGTACGAGTTCTTCGGCCCTGGCACCAGACTGGACCTGAAA

594 GACATCCAGATGACCCAGTCTCCATCCTCTCTGTCTGCCAGAGTGGGCGATACCGCTACCATCACCTGTCAGGCCAACGGCTAC
CTGAACTGGTATCAGCAGAGAAGAGGCAAGGCCCCTAAGCTGCTGATCTACGACGGCTCCAAACTGGAAAGAGGCGTGCCCGCT
AGATTCTCCGGCAGAAGATGGGGCCAAGAGTACACCCTGACCATCAACAACCTGCAGCCTGAGGACGTGGCCACATACTTTTGC
CAGGTGTACGAGTTCATCGTGCCCGGCACCAGACTGGACCTGAAG

595 GATATTCAGATGACACAGAGCCCCAGTAGCCTGAGCGCCCGCGTGGGCGACACCGCGACCATCACCTGTCAGGCCAACGGCTAT
CTGAACTGGTATCAACAGAGGAGGGGCAAGGCCCCCAAGCTCCTGATATACGACGGCAGCAAGCTGGAGAGGGGCGTTCCCGCA
CGCTTCAGCGGCAGGAGGTGGGGCCAGGAGTACACCCTTACAATCAACAACCTGCAGCCCGAGGACGTCGCCACCTATTTCTGC
CAAGTTTACGAGTTCATCGTGCCCGGCACCAGGCTGGACCTGAAG

TABLE XIV

POLYNUCLEOTIDES ENCODING HEAVY CHAIN (HC)

SEQ
ID
NO: POLYNUCLEOTIDE SEQUENCE ENCODING HC

596 CAGGTGCAGTTGTTGCAGTCTGGCGCCGCTGTTACAAAGCCTGGCGCTTCTGTTAGAGTGTCCTGCGAGGCCTCCGGCTACAAC
ATCAGAGACTACTTCATCCACTGGTGGCGGCAGGCTCCAGGACAGGGATTGCAATGGGTCGGATGGATCAACCCCTAAGACCGGC
CAGCCTAACAACCCTAGACAGTTCCAGGGCAGAGTGTCCCTGACCAGACACGCCTCTTGGGACTTCGACACCTTCAGCTTCTAC
ATGGACCTGAAGGCCCTGAGATCCGACGATACCGCCGTGTACTTCTGCGCCAGACAGAGAAGCGACTACTGGGATTTCGATGTG
TGGGGCTCTGGCACCCAAGTGACCGTGTCCTCTGCTTCTACCAAGGGACCCTCTGTGTTCCCTCTGGCTCCTTCCAGCAAGTCT
ACCTCTGGTGGAACCGCTGCTCTGGGCTGCCTGGTCAAGGATTACTTTCCTGAGCCTGTGACAGTGTCCTGGAACTCTGGTGCT
CTGACCTCCGGCGTGCACACATTTCCAGCTGTGCTGCAGTCCTCCGGCCTGTACTCTCTGTCCTCTGTCGTGACCGTGCCTTCT
AGCTCTCTGGGCACCCAGACCTACATCTGCAACGTGAACCACAAGCCTTCCAACACCAAGGTGGACAAGAAGGTGGAACCCAAG
TCCTGCGACAAGACCCACACCTGTCCTCCATGTCCTGCTCCAGAACTGCTGGCTGGCCCCGATGTCTTTCTGTTCCCTCCAAAG
CCTAAGGACACCCTGATGATCTCTCGGACCCCTGAAGTGACCTGCGTGGTGGTGGACGTGTCTCACGAGGATCCCGAAGTGAAG
TTCAATTGGTACGTGGACGGCGTGGAAGTGCACAACGCCAAGACCAAGCCTAGAGAGGAACAGTACAACTCCACCTACAGAGTG
GTGTCCGTGCTGACCGTGCTGCACCAGGATTGGCTGAACGGCAAAGAGTACAAGTGCAAGGTGTCCAACAAGGCCCTGCCTCTG
CCTGAGGAAAAGACCATCTCTAAGGCTAAGGGCCAGCCTCGCGAGCCTCAGGTTTACACACTGCCTCCATCTCGGGAAGAGATG
ACCAAGAACCAGGTGTCACTGACCTGCCTCGTGAAGGGCTTCTACCCTTCCGATATCGCCGTGGAATGGGAGTCCAATGGCCAG
CCTGAGAACAACTACAAGACAACCCCTCCTGTGCTGGACTCCGACGGCTCATTCTTCCTGTACTCCAAGCTGACAGTGGACAAG
TCTCGGTGGCAGCAGGGCAACGTGTTCTCTTGTAGTGTGCTGCACGAGGCCCTGCACTCCCACTATACCCAGAAGTCTCTGTCT
CTGAGCCCCGGCAAA

597 CAGGTGCAGCTGCTGCAGTCTGGCGCCGCTGTGACAAAACCAGGCGCTTCTGTGCGGGTGTCCTGCGAGGCCAGCGGCTACAAC
ATCCGGGACTACTTCATTCACTGGTGGCGCCAGGCCCCTGGACAGGGACTGCAGTGGGTGGGATGGATCAACCCCAAGACCGGC
CAGCCCAACAACCCCAGACAGTTCCAGGGCAGAGTGTCCCTGACCAGACACGCCAGCTGGGACTTCGACACCTTCAGCTTCTAC
ATGGACCTGAAGGCCCTGCGGAGCGACGATACCGCCGTGTACTTCTGCGCCAGACAGAGAAGCGACTACTGGGATTTCGACGTG
TGGGGCAGCGGCACCCAAGTGACCGTGTCATCTGCTAGCACCAAGGGCCCCAGCGTGTTCCCTCTGGCCCCTAGCAGCAAGAGC
ACATCTGGCGGAACAGCCGCCCTGGGCTGCCTCGTGAAGGACTACTTTCCCGAGCCCGTGACCGTGTCCTGGAACTCTGGCGCT
CTGACAAGCGGCGTGCACACCTTTCCAGCCGTGCTGCAGAGCAGCGGCCTGTACTCTCTGAGCAGCGTCGTGACAGTGCCCAGC
AGCTCTCTGGGCACCCAGACCTACATCTGCAACGTGAACCACAAGCCCAGCAACACCAAGGTGGACAAGAAGGTGGAACCCAAG
AGCTGCGACAAGACCCACACCTGTCCCCCTTGTCCTGCCCCCGAACTGCTGGCTGGCCCTGACGTGTTCCTGTTCCCCCCAAAG

TABLE XIV-continued

POLYNUCLEOTIDES ENCODING HEAVY CHAIN (HC)

| SEQ ID NO: | POLYNUCLEOTIDE SEQUENCE ENCODING HC |
|---|---|
| | CCCAAGGACACCCTGATGATCAGCCGGACCCCCGAAGTGACCTGCGTGGTGGTGGATGTGTCCCACGAGGACCCTGAAGTGAAG<br>TTCAATTGGTACGTGGACGGCGTGGAAGTGCACAACGCCAAGACCAAGCCTAGAGAGGAACAGTACAACAGCACCTACCGGGTG<br>GTGTCCGTGCTGACAGTGCTGCACCAGGACTGGCTGAACGGCAAAGAGTACAAGTGCAAGGTGTCCAACAAGGCCCTGCCCCTG<br>CCCGAGGAAAAGACCATCTCTAAGGCCAAGGGACAGCCCCGCGAGCCCCAGGTGTACACACTGCCTCCAAGCCGGGAAGAGATG<br>ACCAAGAACCAGGTGTCCCTGACCTGTCTCGTGAAAGGCTTCTACCCCAGCGACATTGCCGTGGAATGGGAGAGCAACGGCCAG<br>CCCGAGAACAACTACAAGACCACCCCCCCTGTGCTGGACAGCGACGGCTCATTCTTCCTGTACAGCAAGCTGACCGTGGACAAG<br>TCCCGGTGGCAGCAGGGCAACGTGTTCAGCTGTAGCGTGTTGCATGAGGCTCTGCACAGCCACTACACGCAGAAGAGCCTCTCC<br>CTGTCTCCGGGTAAA |
| 598 | CAGGTGCAGTTGTTGCAGTCTGGCGCCGCTGTTACAAAGCCTGGCGCTTCTGTTAGAGTGTCCTGCGAGGCCTCCGGCTACAAC<br>ATCAGAGACTACTTCATCCACTGGTGGCGGCAGGCTCCAGGACAGGGATTGCAATGGGTCGGATGGATCAACCCTAAGACCGGC<br>CAGCCTAACAACCCTAGACAGTTCCAGGGCAGAGTGTCCCTGACCAGACACGCCTCTTTCGACTTCGACACCTTCAGCTTCTAC<br>ATGGACCTGAAGGCCCTGAGATCCGACGATACCGCCGTGTACTTCTGCGCCAGACAGAGAAGCGACTACTGGGACTTCGATGTG<br>TGGGGCTCTGGCACCCAAGTGACCGTGTCCTCTGCTTCTACCAAGGGACCCTCTGTGTTCCCTCTGGCTCCTTCCAGCAAGTCT<br>ACCTCTGGTGGAACCGCTGCTCTGGGCTGCCTGGTCAAGGATTACTTTCCTGAGCCTGTGACAGTGTCCTGGAACTCTGGTGCT<br>CTGACCTCCGGCGTGCACACATTTCCAGCTGTGCTGCAGTCCTCCGGCCTGTACTCTCTGTCCTCTGTCGTGACCGTGCCTTCT<br>AGCTCTCTGGGCACCCAGACCTACATCTGCAACGTGAACCACAAGCCTTCCAACACCAAGGTGGACAAGAAGGTGGAACCCAAG<br>TCCTGCGACAAGACCCACACCTGTCCTCCATGTCCTGCTCCAGAACTGCTGGCTGGCCCCGATGTCTTTCTGTTCCCTCCAAAG<br>CCTAAGGACACCCTGATGATCTCTCGGACCCCTGAAGTGACCTGCGTGGTGGTGATGTGTCTCACGAGGATCCCGAAGTGAAG<br>TTCAATTGGTACGTGGACGGCGTGGAAGTGCACAACGCCAAGACCAAGCCTAGAGAGGAACAGTACAACTCCACCTACAGAGTG<br>GTGTCCGTGCTGACCGTGCTGCACCAGGATTGGCTGAACGGCAAAGAGTACAAGTGCAAGGTGTCCAACAAGGCCCTGCCTCTG<br>CCTGAGGAAAAGACCATCTCTAAGGCTAAGGGCCAGCCTCGCGAGCCTCAGGTTTACACACTGCCTCCATCTCGGGAAGAGATG<br>ACCAAGAACCAGGTGTCACTGACCTGCCTCGTGAAGGGCTTCTACCCTTCCGATATCGCCGTGGAATGGGAGTCCAATGGCCAG<br>CCTGAGAACAACTACAAGACAACCCCTCCTGTGCTGGACTCCGACGGCTCATTCTTCCTGTACTCCAAGCTGACAGTGGACAAG<br>TCTCGGTGGCAGCAGGGCAACGTGTTCTCTTGTAGTGTGCTGCACGAGGCCCTGCACTCCCACTATACCCAGAAGTCTCTGTCT<br>CTGAGCCCCGGCAAA |
| 599 | CAGGTGCAGCTGCTGCAGTCTGGCGCCGCTGTGACAAAACCAGGCGCTTCTGTGCGGGTGTCCTGCGAGGCCAGCGGCTACAAC<br>ATCCGGGACTACTTCATTCACTGGTGGCGCCAGGCCCCTGGACAGGGACTGCAGTGGGTGGGATGGATCAACCCCAAGACCGGC<br>CAGCCCAACAACCCCAGACAGTTCCAGGGCAGAGTGTCCCTGACCAGACACGCCAGCTTCGACTTCGACACCTTCAGCTTCTAC<br>ATGGACCTGAAGGCCCTGCGGGAGCGACGATACCGCCGTGTACTTCTGCGCCAGACAGAGAAGCGACTACTGGGATTTCGACGTG<br>TGGGGCAGCGGCACCCAAGTGACCGTGTCATCTGCTAGCACCAAGGGCCCCAGCGTGTTCCCTCTGGCCCCTAGCAGCAAGAGC<br>ACATCTGGCGGAACAGCCGCCCTGGGCTGCCTCGTGAAGGACTACTTTCCCGAGCCCGTGACCGTGTCCTGGAACTCTGGCGCT<br>CTGACAAGCGGCGTGCACACCTTTCCAGCCGTGCTGCAGAGCAGCGGCCTGTACTCTCTGAGCAGCGTCGTGACAGTGCCCAGC<br>AGCTCTCTGGGCACCCAGACCTACATCTGCAACGTGAACCACAAGCCCAGCAACACCAAGGTGGACAAGAAGGTGGAACCCAAG<br>AGCTGCGACAAGACCCACACCTGTCCCCCTTGTCCTGCCCCCAAGCTGCTGGCTGGCCCCTGACGTGTTCCTGTTCCCCCCAAAG<br>CCCAAGGACACCCTGATGATCAGCCGGACCCCCGAAGTGACCTGCGTGGTGGTGGATGTGTCCCACGAGGACCCTGAAGTGAAG<br>TTCAATTGGTACGTGGACGGCGTGGAAGTGCACAACGCCAAGACCAAGCCTAGAGAGGAACAGTACAACAGCACCTACCGGGTG<br>GTGTCCGTGCTGACAGTGCTGCACCAGGACTGGCTGAACGGCAAAGAGTACAAGTGCAAGGTGTCCAACAAGGCCCTGCCCCTG<br>CCCGAGGAAAAGACCATCTCTAAGGCCAAGGGACAGCCCCGCGAGCCCCAGGTGTACACACTGCCTCCAAGCCGGGAAGAGATG<br>ACCAAGAACCAGGTGTCCCTGACCTGTCTCGTGAAAGGCTTCTACCCCAGCGACATTGCCGTGGAATGGGAGAGCAACGGCCAG<br>CCCGAGAACAACTACAAGACCACCCCCCCTGTGCTGGACAGCGACGGCTCATTCTTCCTGTACAGCAAGCTGACCGTGGACAAG<br>TCCCGGTGGCAGCAGGGCAACGTGTTCAGCTGTAGCGTGTTGCATGAGGCTCTGCACAGCCACTACACGCAGAAGAGCCTCTCC<br>CTGTCTCCGGGTAAA |
| 600 | CAGGTCCACTTGTCTCAATCTGGCGCCGCTGTGACAAAGCCTGGCGCTTCTGTCAGAGTGTCTTGCGAGGCCTCTGGCTACAAG<br>ATCCGGGACCACTTTATCCACTGGTGGCGACAGGCTCCAGGACAGGGATTGCAGTGGGTCGGATGGATCAACCCTAAGACCGGC<br>CAGCCTAACAACCCTAGACAGTTCCAGGGCAGAGTGTCCCTGACCAGACACGCCTCTTGGGACTTCGACACCTTCAGCTTCTAC<br>ATGGACCTGAAGGCCGTGCGGAGCGACGACACCGCTATCTACTTTTGCGCCAGACAGAGATCCGACTACTGGGATTTCGATGTG<br>TGGGGCTCTGGCACCCAAGTGACCGTGTCCTCTGCTTCTACCAAGGGACCCTCTGTGTTCCCTCTGGCTCCTTCCAGCAAGTCT<br>ACCTCTGGTGGAACCGCTGCTCTGGGCTGCCTGGTCAAGGATTACTTTCCTGAGCCTGTGACAGTGTCCTGGAACTCTGGTGCT<br>CTGACCTCCGGCGTGCACACATTTCCAGCTGTGCTGCAGTCCTCCGGCCTGTACTCTCTGTCCTCTGTCGTGACCGTGCCTTCT<br>AGCTCTCTGGGCACCCAGACCTACATCTGCAACGTGAACCACAAGCCTTCCAACACCAAGGTGGACAAGAAGGTGGAACCCAAG<br>TCCTGCGACAAGACCCACACCTGTCCTCCATGTCCTGCTCCAGAACTGCTGGCTGGCCCCGATGTCTTTCTGTTCCCTCCAAAG<br>CCTAAGGACACCCTGATGATCTCTCGGACCCCTGAAGTGACCTGCGTGGTGGTGATGTGTCTCACGAGGATCCCGAAGTGAAG<br>TTCAATTGGTACGTGGACGGCGTGGAAGTGCACAACGCCAAGACCAAGCCTAGAGAGGAACAGTACAACTCCACCTACAGAGTG<br>GTGTCCGTGCTGACCGTGCTGCACCAGGATTGGCTGAACGGCAAAGAGTACAAGTGCAAGGTGTCCAACAAGGCCCTGCCTCTG<br>CCTGAGGAAAAGACCATCTCTAAGGCTAAGGGCCAGCCTCGCGAGCCTCAGGTTTACACACTGCCTCCATCTCGGGAAGAGATG<br>ACCAAGAACCAGGTGTCACTGACCTGCCTCGTGAAGGGCTTCTACCCTTCCGATATCGCCGTGGAATGGGAGTCCAATGGCCAG<br>CCTGAGAACAACTACAAGACAACCCCTCCTGTGCTGGACTCCGACGGCTCATTCTTCCTGTACTCCAAGCTGACAGTGGACAAG<br>TCTCGGTGGCAGCAGGGCAACGTGTTCTCTTGTAGTGTGCTGCACGAGGCCCTGCACTCCCACTATACCCAGAAGTCCCTGTCT<br>CTGTCCCCTGGCAAA |
| 601 | CAGGTCCACCTGTCTCAATCTGGCGCCGCTGTTACAAAACCAGGCGCCTCTGTTAGAGTGTCTTGCGAGGCCAGCGGCTACAAG<br>ATCAGGGACACTTTATTCACTGGTGGCGCCAGGCTCCAGGACAGGGCTTCAATGGGTCGGATGGATCAACCCTAAGACCGGC<br>CAGCCTAACAACCCAGACAGTTCCAGGGCAGAGTGTCTCTGACAAGACACGCCAGCTGGGACTTCGACACCTTCAGCTTCTAC<br>ATGGACCTGAAGGCCGTGCGGAGCGACGACACCGCCATCTATTTTGCGCCAGACAGAGAAGCGACTACTGGGATTTCGATGTG<br>TGGGGCAGCGGCACCCAAGTGACAGTCTCTTCTGCTAGCACCAAGGGCCCCAGCGTGTTCCCTCTGGCCCCTAGCAGCAAGAGC<br>ACATCTGGCGGAACAGCCGCCCTGGGCTGCCTCGTGAAGGACTACTTTCCCGAGCCCGTGACCGTGTCCTGGAACTCTGGCGCT<br>CTGACAAGCGGCGTGCACACCTTTCCAGCCGTGCTGCAGAGCAGCGGCCTGTACTCTCTGAGCAGCGTCGTGACAGTGCCCAGC<br>AGCTCTCTGGGCACCCAGACCTACATCTGCAACGTGAACCACAAGCCCAGCAACACCAAGGTGGACAAGAAGGTGGAACCCAAG<br>AGCTGCGACAAGACCCACACCTGTCCCCCTTGTCCTGCCCCCAACTGCTGGCTGGCCCTGACGTGTTCCTGTTCCCCCCAAAG<br>CCCAAGGACACCCTGATGATCAGCCGGACCCCCGAAGTGACCTGCGTGGTGGTGGATGTGTCCCACGAGGACCCTGAAGTGAAG<br>TTCAATTGGTACGTGGACGGCGTGGAAGTGCACAACGCCAAGACCAAGCCTAGAGAGGAACAGTACAACAGCACCTACCGGGTG |

TABLE XIV-continued

POLYNUCLEOTIDES ENCODING HEAVY CHAIN (HC)

SEQ
ID
NO: POLYNUCLEOTIDE SEQUENCE ENCODING HC

GTGTCCGTGCTGACAGTGCTGCACCAGGACTGGCTGAACGGCAAAGAGTACAAGTGCAAGGTGTCCAACAAGGCCCTGCCCCTG
CCCGAGGAAAAGACCATCTCTAAGGCCAAGGGACAGCCCCGCGAGCCCCAGGTGTACACACTGCCTCCAAGCCGGGAAGAGATG
ACCAAGAACCAGGTGTCCCTGACCTGTCTCGTGAAAGGCTTCTACCCCAGCGACATTGCCGTGGAATGGGAGAGCAACGGCCAG
CCCGAGAACAACTACAAGACCACCCCCCCTGTGCTGGACAGCGACGGCTCATTCTTCCTGTACAGCAAGCTGACCGTGGACAAG
TCCCGGTGGCAGCAGGGCAACGTGTTCAGCTGTAGCGTGTTGCATGAGGCTCTGCACAGCCACTACACGCAGAAGAGCCTCTCC
CTGTCTCCGGGTAAA

602 CAGGTCCACTTGTCTCAATCGGCGCCGCTGTGACAAAGCCTGGCGCTTCTGTCAGAGTGTCTTGCGAGGCCTCTGGCTACAAG
ATCCGGGACCACTTTATCCACTGGTGGCGACAGGCTCCAGGACAGGGATTGCAGTGGGTCGGATGGATCAACCCTAAGACCGGC
CAGCCTAACAACCCTAGACAGTTCCAGGGCAGAGTGTCCCTGACCAGACACGCCTCTTTCGACTTCGACACCTTCAGCTTCTAC
ATGGACCTGAAGGCCGTGCGGAGCGACGACACCGCTATCTACTTTTTGCGCCAGACAGAGATCCGACTACTGGGACTTCGATGTG
TGGGGCTCTGGCACCCAAGTGACCGTGTCCTCTGCTTCTACCAAGGGACCCTCTGTGTTCCCTCTGGCTCCTTCCAGCAAGTCT
ACCTCTGGTGGAACCGCTGCTCTGGGCTGCCTGGTCAAGGATTACTTTCCTGAGCCTGTGACAGTGTCCTGGAACTCTGGTGCT
CTGACCTCCGGCGTGCACACATTTCCAGCTGTGCTGCAGTCCTCCGGCCTGTACTCTCTGTCCTCTGTCGTGACCGTGCCTTCT
AGCTCTCTGGGCACCCAGACCTACATCTGCAACGTGAACCACAAGCCTTCCAACACCAAGGTGGACAAGAAGGTGGAACCCAAG
TCCTGCGACAAGACCCACACCTGTCCTCCATGTCCTGCTCCAGAACTGCTGGCTGGCCCCGATGTCTTTCTGTTCCCTCCAAAG
CCTAAGGACACCCTGATGATCTCTCGGACCCCTGAAGTGACCTGCGTGGTGGTGGATGTGTCTCACGAGGATCCCGAAGTGAAG
TTCAATTGGTACGTGGACGGCGTGGAAGTGCACAACGCCAAGACCAAGCCTAGAGAGGAACAGTACAACTCCACCTACAGAGTG
GTGTCCGTGCTGACCGTGCTGCACCAGGATTGGCTGAACGGCAAAGAGTACAAGTGCAAGGTGTCCAACAAGGCCCTGCCTCTG
CCTGAGGAAAAGACCATCTCTAAGGCTAAGGGCCAGCCTCGCGAGCCTCAGGTTTACACACTGCCTCCATCTCGGGAAGAGATG
ACCAAGAACCAGGTGTCACTGACCTGCCTCGTGAAGGGCTTCTACCCTTCCGATATCGCCGTGGAATGGGAGTCCAATGGCCAG
CCTGAGAACAACTACAAGACAACCCCTCCTGTGCTGGACTCCGACGGCTCATTCTTCCTGTACTCCAAGCTGACAGTGGACAAG
TCTCGGTGGCAGCAGGGCAACGTGTTCTCTTGTAGTGTGCTGCACGAGGCCCTGCACTCCCACTATACCCAGAAGTCCCTGTCT
CTGTCCCCTGGCAAA

603 CAGGTCCACCTGTCTCAATCGGCGCCGCTGTTACAAAACCAGGCGCCTCTGTTAGAGTGTCTTGCGAGGCCAGCGGCTACAAG
ATCAGGGACACTTTATTCACTGGTGGCGCCAGGCTCCAGGACAGGGACTTCAATGGGTCGGATGGATCAACCCTAAGACCGGC
CAGCCTAACAACCCCAGACAGTTCCAGGGCAGAGTGTCTCTGACAAGACACGCCAGCTTCGACTTCGACACCTTCAGCTTCTAC
ATGGACCTGAAGGCCGTGCGGAGCGACGACACCGCCATCTATTTTTGCGCCAGACAGAGAAGCGACTACTGGGATTTCGATGTG
TGGGGCAGCGGCACCCAAGTGACAGTCTCTTCTGCTAGCACCAAGGGCCCCAGCGTGTTCCCTCTGGCCCCTAGCAGCAAGAGC
ACATCTGGCGGAACAGCCGCCCTGGGCTGCCTCGTGAAGGACTACTTTCCCGAGCCCGTGACCGTGTCCTGGAACTCTGGCGCT
CTGACAAGCGGCGTGCACACCTTTCCAGCTGTGCTGCAGAGCAGCGGCCTGTACTCTCTGAGCAGCGTCGTGACAGTGCCCAGC
AGCTCTCTGGGCACCCAGACCTACATCTGCAACGTGAACCACAAGCCCAGCAACACCAAGGTGGACAAGAAGGTGGAACCCAAG
AGCTGCGACAAGACCCACACCTGTCCCCCTTGTCCTGCCCCCGAACTGCTGGCTGGCCCTGACGTGTTCCTGTTCCCCCCAAAG
CCCAAGGACACCCTGATGATCAGCCGGACCCCCGAAGTGACCTGCGTGGTGGTGGATGTGTCCCACGAGGACCCTGAAGTGAAG
TTCAATTGGTACGTGGACGGCGTGGAAGTGCACAACGCCAAGACCAAGCCTAGAGAGGAACAGTACAACAGCACCTACCGGGTG
GTGTCCGTGCTGACAGTGCTGCACCAGGACTGGCTGAACGGCAAAGAGTACAAGTGCAAGGTGTCCAACAAGGCCCTGCCCCTG
CCCGAGGAAAAGACCATCTCTAAGGCCAAGGGACAGCCCCGCGAGCCCCAGGTGTACACACTGCCTCCAAGCCGGGAAGAGATG
ACCAAGAACCAGGTGTCCCTGACCTGTCTCGTGAAAGGCTTCTACCCCAGCGACATTGCCGTGGAATGGGAGAGCAACGGCCAG
CCCGAGAACAACTACAAGACCACCCCCCCTGTGCTGGACAGCGACGGCTCATTCTTCCTGTACAGCAAGCTGACCGTGGACAAG
TCCCGGTGGCAGCAGGGCAACGTGTTCAGCTGTAGCGTGTTGCATGAGGCTCTGCACAGCCACTACACGCAGAAGAGCCTCTCC
CTGTCTCCGGGTAAA

604 CAGGTCCACTTGTCTCAATCGGCGCCGCTGTGACAAAGCCTGGCGCTTCTGTCAGAGTGTCTTGCGAGGCCTCCGGCTACAAC
ATCCGGGACTACTTTATCCACTGGTGGCGGCAGGCTCCAGGACAGGGATTGCAATGGGTCGGATGGATCAACCCTAAGACCGGC
CAGCCTAACAACCCTAGACAGTTCCAGGGCAGAGTGTCCCTGACCAGACACGCCTCTTGGGACTTCGACACCTTCAGCTTCTAC
ATGGACCTGAAGGCCGTGCGGAGCGACGACACCGCTATCTACTTTTTGCGCCAGACAGAGATCCGACTACTGGGATTTCGATGTG
TGGGGCTCTGGCACCCAAGTGACCGTGTCCTCTGCTTCTACCAAGGGACCCTCTGTGTTCCCTCTGGCTCCTTCCAGCAAGTCT
ACCTCTGGTGGAACCGCTGCTCTGGGCTGCCTGGTCAAGGATTACTTTCCTGAGCCTGTGACAGTGTCCTGGAACTCTGGTGCT
CTGACCTCCGGCGTGCACACATTTCCAGCTGTGCTGCAGTCCTCCGGCCTGTACTCTCTGTCCTCTGTCGTGACCGTGCCTTCT
AGCTCTCTGGGCACCCAGACCTACATCTGCAACGTGAACCACAAGCCTTCCAACACCAAGGTGGACAAGAAGGTGGAACCCAAG
TCCTGCGACAAGACCCACACCTGTCCTCCATGTCCTGCTCCAGAACTGCTGGCTGGCCCCGATGTCTTTCTGTTCCCTCCAAAG
CCTAAGGACACCCTGATGATCTCTCGGACCCCTGAAGTGACCTGCGTGGTGGTGGATGTGTCTCACGAGGATCCCGAAGTGAAG
TTCAATTGGTACGTGGACGGCGTGGAAGTGCACAACGCCAAGACCAAGCCTAGAGAGGAACAGTACAACTCCACCTACAGAGTG
GTGTCCGTGCTGACCGTGCTGCACCAGGATTGGCTGAACGGCAAAGAGTACAAGTGCAAGGTGTCCAACAAGGCCCTGCCTCTG
CCTGAGGAAAAGACCATCTCTAAGGCTAAGGGCCAGCCTCGCGAGCCTCAGGTTTACACACTGCCTCCATCTCGGGAAGAGATG
ACCAAGAACCAGGTGTCACTGACCTGCCTCGTGAAGGGCTTCTACCCTTCCGATATCGCCGTGGAATGGGAGTCCAATGGCCAG
CCTGAGAACAACTACAAGACAACCCCTCCTGTGCTGGACTCCGACGGCTCATTCTTCCTGTACTCCAAGCTGACAGTGGACAAG
TCTCGGTGGCAGCAGGGCAACGTGTTCTCTTGTAGTGTGCTGCACGAGGCCCTGCACTCCCACTATACCCAGAAGTCCCTGTCT
CTGTCCCCTGGCAAA

605 CAGGTCCACCTGTCTCAATCGGCGCCGCTGTTACAAAACCAGGCGCCTCTGTTAGAGTGTCTTGCGAGGCCAGCGGCTACAAC
ATCCGGGACTACTTTATTCACTGGTGGCGCCAGGCTCCAGGACAGGGACTTCAATGGGTCGGATGGATCAACCCTAAGACCGGC
CAGCCTAACAACCCCAGACAGTTCCAGGGCAGAGTGTCTCTGACAAGACACGCCAGCTGGGACTTCGACACCTTCAGCTTCTAC
ATGGACCTGAAGGCCGTGCGGAGCGACGACACCGCCATCTATTTTTGCGCCAGACAGAGAAGCGACTACTGGGATTTCGATGTG
TGGGGCAGCGGCACCCAAGTGACAGTCTCTTCTGCTAGCACCAAGGGCCCCAGCGTGTTCCCTCTGGCCCCTAGCAGCAAGAGC
ACATCTGGCGGAACAGCCGCCCTGGGCTGCCTCGTGAAGGACTACTTTCCCGAGCCCGTGACCGTGTCCTGGAACTCTGGCGCT
CTGACAAGCGGCGTGCACACCTTTCCAGCCGTGCTGCAGAGCAGCGGCCTGTACTCTCTGAGCAGCGTCGTGACAGTGCCCAGC
AGCTCTCTGGGCACCCAGACCTACATCTGCAACGTGAACCACAAGCCCAGCAACACCAAGGTGGACAAGAAGGTGGAACCCAAG
AGCTGCGACAAGACCCACACCTGTCCCCCTTGTCCTGCCCCCGAACTGCTGGCTGGCCCTGACGTGTTCCTGTTCCCCCCAAAG
CCCAAGGACACCCTGATGATCAGCCGGACCCCCGAAGTGACCTGCGTGGTGGTGGATGTGTCCCACGAGGACCCTGAAGTGAAG
TTCAATTGGTACGTGGACGGCGTGGAAGTGCACAACGCCAAGACCAAGCCTAGAGAGGAACAGTACAACAGCACCTACCGGGTG
GTGTCCGTGCTGACAGTGCTGCACCAGGACTGGCTGAACGGCAAAGAGTACAAGTGCAAGGTGTCCAACAAGGCCCTGCCCCTG
CCCGAGGAAAAGACCATCTCTAAGGCCAAGGGACAGCCCCGCGAGCCCCAGGTGTACACACTGCCTCCAAGCCGGGAAGAGATG

TABLE XIV-continued

POLYNUCLEOTIDES ENCODING HEAVY CHAIN (HC)

| SEQ ID NO: | POLYNUCLEOTIDE SEQUENCE ENCODING HC |
|---|---|
| | ACCAAGAACCAGGTGTCCCTGACCTGTCTCGTGAAAGGCTTCTACCCCAGCGACATTGCCGTGGAATGGGAGAGCAACGGCCAG CCCGAGAACAACTACAAGACCACCCCCCCTGTGCTGGACAGCGACGGCTCATTCTTCCTGTACAGCAAGCTGACCGTGGACAAG TCCCGGTGGCAGCAGGGCAACGTGTTCAGCTGTAGCGTGTTGCATGAGGCTCTGCACAGCCACTACACGCAGAAGAGCCTCTCC CTGTCTCCGGGTAAA |

TABLE XV

POLYNUCLEOTIDES ENCODING LIGHT CHAIN (LC)

| SEQ ID NO: | POLYNUCLEOTIDE SEQUENCE ENCODING LC |
|---|---|
| 606 | GACATCCAGATGACCCAGAGCCCTTCCTCTTTATCCGCTAGCGTCGGCGATACCGTGACCATCACATGCCAAGCTAACGGCTAC CTCAACTGGTACCAGCAGCGGAGGGGAAAGGCCCCCAAGCTGCTGATCTACGACGGCTCCAAGCTGGAGAGGGGAGTGCCTTCC CGGTTCAGCGGAAGGAGGTGGGGACAAGAATACAATTTAACCATCAACAATTTACAGCCGAGGACATCGCTACCTACTTCTGC CAAGTTTACGAGTTCGTGGTGCCCGGCACTCGTCTGGATCTGAAGAGGACCGTGGCCGCCCCCTCCGTGTTCATCTTTCCCCCT TCCGACGAGCAGCTCGAAGTCCGGCACCGCCTCCGTGGTGTGTTTACTGAACAACTTCTACCCTCGTGAGGCCAAGGTGCAGTGG AAGGTGGACAACGCTTTACAGTCCGGCAACTCCCAAGAATCCGTGACCGAGCAAGATAGCAAGGACTCCACCTACTCCCTCTCC AGCACTTTAACTTTATCCAAGGCCGACTACGAGAAGCACAAGGTGTACGCTTGTGAGGTGACCCACCAAGGTCTGTCCTCCCCC GTGACAAAGTCCTTCAATCGGGGCGAGTGT |
| 607 | GACATCCAGATGACCCAGAGCCCTAGCAGCCTGAGCGCCAGCGTGGGCGATACCGTGACCATTACCTGCCAGGCCAACGGCTAC CTGAACTGGTATCAGCAGCGGAGAGGCAAGGCCCCCAAGCTGCTGATCTACGACGGCAGCAAGCTGGAAAGAGGCGTGCCCAGC AGATTCAGCGGCAGAAGATGGGGCCAGGAGTACAACCTGACCATCAACAACCTGCAGCCCGAGGATATCGCCACATACTTTTGC CAGGTGTACGAGTTCGTGGTGCCCGGCACACGCTGGACCTGAAACGTACGGTGGCTGCACCATCTGTCTTCATCTTCCCGCCA TCTGATGAGCAGTTGAAATCTGGAACTGCCTCTGTTGTGTGCCTGCTGAATAACTTCTATCCCAGAGAGGCCAAAGTACAGTGG AAGGTGGATAACGCCCTCCAATCGGGTAACTCCCAGGAGAGTGTCACAGAGCAGGACAGCAAGGACAGCACCTACAGCCTCAGC AGCACCCTGACGCTGAGCAAAGCAGACTACGAGAAACACAAAGTCTACGCCTGCGAAGTCACCCATCAGGGCCTGAGCTCGCCC GTCACAAAGAGCTTCAACAGGGGAGAGTGT |
| 608 | GACATCCAGATGACCCAGTCTCCATCCTCTCTGTCTGCCTCTGTGGGCGATACCGCTACCATCACCTGTCAGGCCAACGGCTAC CTGAACTGGTATCAGCAGAGAGAGGCAAGGCCCCTAAGCTGCTGATCTACGACGGCTCCAAACTGGAAAGAGGCGTGCCCTCT CGGTTCTCTGGCAGAAGATGGGGCCAAGAGTACAACCTGACCATCAACAACCTGCAGCCTGAGGATATCGCCACATACTTTTGC CAGGTGTACGAGTTCGTGGTGCCTGGCACAAGACTGGACCTGAAGAGAACCGTGGCCGCTCCTTCCGTGTTCATCTTCCCACCA TCTGACGAGCAGCTGAAGTCTGGCACCGCTTCTGTCGTGTGCCTGCTGAACAACTTCTACCCTCGGGAAGCCAAGGTGCAGTGG AAGGTGGACAATGCCCTGCAGTCCGGCAACTCCCAAGAGTCTGTGACCGAGCAGGACTCCAAGGACTCTACCTACAGCCTGTCC TCCACACTGACCCTGTCTAAGGCCGACTACGAGAAGCACAAGGTGTACGCCTGCGAAGTGACCCATCAGGGACTGTCTAGCCCC GTGACCAAGTCCTTCAACAGAGGCGAGTGT |
| 609 | GATATTCAGATGACACAGAGCCCCAGTAGCCTGAGCGCCAGCGTGGGCGACACCGCAACCATCACCTGTCAGGCCAACGGCTAT CTGAACTGGTATCAACAGAGGAGGGGCAAGGCCCCCAAGCTCCTGATATACGACGGCAGCAAGCTGGAGAGGGGCGTTCCCAGC CGCTTCAGCGGCAGGAGGTGGGGCCAGGAGTACAACCTTACAATCAACAACCTGCAGCCCGAGGACATCGCCACCTATTTCTGC CAAGTTTACGAGTTCGTGGTGCCCGGCACCAGGCTGGACCTGAAGCGGACCGTGGCCGCCCCCAGCGTGTTCATCTTCCCTCCC AGCGACGAGCAGCTGAAGTCTGGCACCGCCAGCGTGGTGTGCCTGCTGAACAACTTCTACCCCCGCGAGGCCAAGGTGCAGTGG AAGGTGGACAACGCCCTGCAGAGCGGCAACAGCCAGGAGAGCGTGACCGAGCAGGACTCCAAGGACAGCACCTACAGCCTGAGC AGCACCCTGACCCTGAGCAAGGCCGACTACGAGAAGCACAAGGTGTACGCCTGCGAGGTGACCCACCAGGGACTGTCTAGCCCC GTGACCAAGAGCTTCAACCGGGGCGAGTGC |
| 610 | GACATCCAGATGACCCAGTCTCCATCCTCTCTGTCTGCCTCTGTGGGCGACAGAGCTACCATCACCTGTCAGGCCAACGGCTAC CTGAACTGGTATCAGCAGAGAAGAGGCAAGGCCCCTAAGCTGCTGATCTACGACGGCTCCAAACTGGAAAGAGGCGTGCCCTCC AGATTCTCCGGCTCTAGATGGGGCCAAGAGTACAACCTGACCATCTCCAGCCTCCAGCCTGAGGATATCGCCACATACTTTTGC CAGGTGTACGAGTTCTTCGGCCCTGGCACCAGACTGGACCTGAAGAGAACAGTGGCCGCTCCTTCCGTGTTCATCTTCCCACCA TCTGACGAGCAGCTGAAGTCTGGCACCGCTTCTGTCGTGTGCCTGCTGAACAACTTCTACCCTCGGGAAGCCAAGGTGCAGTGG AAGGTGGACAATGCTCTCCAGTCCGGCAACTCCCAAGAGTCTGTGACCGAGCAGGACTCCAAGGACTCTACCTACAGCCTGTCC TCCACACTGACCCTGTCTAAGGCCGACTACGAGAAGCACAAGGTGTACGCCTGCGAAGTGACCCATCAGGGACTGTCTAGCCCC GTGACCAAGTCCTTCAACAGAGGCGAGTGT |
| 611 | GATATTCAGATGACACAGAGCCCCAGTAGCCTGAGCGCCAGCGTGGGCGACAGAGCAACCATCACCTGTCAGGCCAACGGCTAT CTGAACTGGTATCAACAGAGAAGGGGCAAGGCCCCCAAGCTCCTGATATACGACGGCAGCAAGCTGGAGAGGGGCGTTCCCAGC CGCTTCAGCGGCTCAAGGTGGGGCCAGGAGTACAACCTTACAATCTCATCCCTGCAGCCCGAGGACATCGCCACCTATTTCTGC CAAGTTTACGAGTTCTTCGGCCCTGGCACCAGGCTGGACCTGAAGCGGACCGTGGCCGCCCCCAGCGTGTTCATCTTCCCTCCC AGCGACGAGCAGCTGAAGTCTGGCACCGCCAGCGTGGTGTGCCTGCTGAACAACTTCTACCCCCGCGAGGCCAAGGTGCAGTGG AAGGTGGACAACGCCCTGCAGAGCGGCAACAGCCAGGAGAGCGTGACCGAGCAGGACTCCAAGGACAGCACCTACAGCCTGAGC AGCACCCTGACCCTGAGCAAGGCCGACTACGAGAAGCACAAGGTGTACGCCTGCGAGGTGACCCACCAGGGACTGTCTAGCCCC GTGACCAAGAGCTTCAACCGGGGCGAGTGC |
| 612 | GACATCCAGATGACCCAGTCTCCATCCTCTCTGTCTGCCAGAGTGGGCGACACCGTGACAATCACCTGTCAGGCCAACGGCTAC CTGAACTGGTATCAGCAGAGAAGAGGCAAGGCCCCTAAGCTGCTGATCTACGACGGCTCCAAACTGGAAAGAGGCGTGCCCGCT AGATTCTCCGGCAGAAGATGGGGCCAAGAGTACAACCTGACCATCAACAACCTGCAGCCTGAGGACGTGGCCACATACTTTTGC CAGGTGTACGAGTTCATCGTGCCCGGCACCAGACTGGACCTGAAGAACAGTTGCCGCTCCTTCCGTGTTCATCTTCCCACCT |

TABLE XV-continued

POLYNUCLEOTIDES ENCODING LIGHT CHAIN (LC)

| SEQ ID NO: | POLYNUCLEOTIDE SEQUENCE ENCODING LC |
|---|---|
| | TCCGACGAGCAGCTGAAGTCTGGCACAGCTTCTGTCGTGTGCCTGCTGAACAACTTCTACCCTCGGGAAGCCAAGGTGCAGTGG<br>AAGGTGGACAATGCCCTGCAGTCCGGCAACTCCCAAGAGTCTGTGACCGAGCAGGACTCCAAGGACTCTACCTACAGCCTGTCC<br>TCCACACTGACCCTGTCTAAGGCCGACTACGAGAAGCACAAGGTGTACGCCTGCGAAGTGACCCATCAGGGACTGTCTAGCCCC<br>GTGACCAAGTCCTTCAACAGAGGCGAGTGT |
| 613 | GATATTCAGATGACACAGAGCCCCAGTAGCCTGAGCGCCCGCGTGGGCGACACCGTGACCATCACCTGTCAGGCCAACGGCTAT<br>CTGAACTGGTATCAACAGAGGAGGGGCAAGGCCCCCAAGCTCCTGATATACGACGGCAGCAAGCTGGAGAGGGGCGTTCCCGCA<br>CGCTTCAGCGGCAGGAGGTGGGGCCAGGAGTACAACCTTACAATCAACAACCTGCAGCCCGAGGACGTCGCCACCTATTTCTGC<br>CAAGTTTACGAGTTCATCGTGCCCGGCACCAGGCTGGACCTGAAGCGGACCGTGGCCGCCCCAGCGTGTTCATCTTCCCTCCC<br>AGCGACGAGCAGCTGAAGTCTGGCACCGCCAGCGTGGTGTGCCTGCTGAACAACTTCTACCCCCGCGAGGCCAAGGTGCAGTGG<br>AAGGTGGACAACGCCCTGCAGAGCGGCAACAGCCAGGAGAGCGTGACCGAGCAGGACTCCAAGGACAGCACCTACAGCCTGAGC<br>AGCACCCTGACCCTGAGCAAGGCCGACTACGAGAAGCACAAGGTGTACGCCTGCGAGGTGACCCACCAGGGACTGTCTAGCCCC<br>GTGACCAAGAGCTTCAACCGGGGCGAGTGC |
| 614 | GACATCCAGATGACCCAGTCTCCATCCTCTCTGTCTGCCTCTGTGGGCGATACCGCTACCATCACCTGTCAGGCCAACGGCTAC<br>CTGAACTGGTATCAGCAGAGAAGAGGCAAGGCCCCTAAGCTGCTGATCTACGACGGCTCCAAACTGGAAAGAGGCGTGCCCTCT<br>CGGTTCTCTGGCAGAAGATGGGGCCAAGAGTACACCCTGACCATCAACAACCTGCAGCCTGAGGATATCGCCACATACTTTTGC<br>CAGGTGTACGAGTTCTTCGGCCCTGGCACCAGACTGGACCTGAAGAGAACAGTGGCCGCTCCTTCCGTGTTCATCTTCCCACCA<br>TCTGACGAGCAGCTGAAGTCTGGCACCGCTTCTGTCGTGTGCCTGCTGAACAACTTCTACCCTCGGGAAGCCAAGGTGCAGTGG<br>AAGGTGGACAATGCCCTGCAGTCCGGCAACTCCCAAGAGTCTGTGACCGAGCAGGACTCCAAGGACTCTACCTACAGCCTGTCC<br>TCCACACTGACCCTGTCTAAGGCCGACTACGAGAAGCACAAGGTGTACGCCTGCGAAGTGACCCATCAGGGACTGTCTAGCCCC<br>GTGACCAAGTCCTTCAACAGAGGCGAGTGT |
| 615 | GACATCCAGATGACACAGAGCCCTAGCAGCCTGTCTGCCAGCGTGGGAGATACCGCCACAATTACCTGTCAGGCCAACGGCTAC<br>CTGAACTGGTATCAGCAGCGGAGAGGCAAGGCCCCTAAGCTGCTGATCTACGACGGCAGCAAGCTGGAAAGAGGCGTGCCCAGC<br>AGATTCAGCGGCAGAAGATGGGGCCAAGAGTACACCCTGACCATCAACAACCTGCAGCCTGAGGATATTGCCACATACTTTTGC<br>CAGGTGTACGAGTTCTTCGGCCCTGGCACCAGACTGGACCTGAAGAGAACAGTGGCCGCTCCTAGCGTGTTCATCTTCCCACCT<br>TCCGACGAGCAGCTGAAGTCTGGCACAGCCTCTGTCGTGTGCCTGCTGAACAACTTCTACCCCAGAGAAGCCAAGGTGCAGTGG<br>AAGGTGGACAACGCCCTGCAGAGCGGCAATAGCCAAGAGAGCGTGACCGAGCAGGACAGCAAGGACTCTACCTACTCTCTGAGC<br>AGCACCCTGACACTGAGCAAGGCCGACTACGAGAAGCACAAAGTGTACGCCTGCGAAGTGACCCACCAGGGCCTTTCTAGCCCT<br>GTGACCAAGAGCTTCAACCGGGGCGAGTGT |
| 616 | GACATCCAGATGACCCAGTCTCCATCCTCTCTGTCTGCCTCTGTGGGCGACAGAGCTACCATCACCTGTCAGGCCAACGGCTAC<br>CTGAACTGGTATCAGCAGAGAAGAGGCAAGGCCCCTAAGCTGCTGATCTACGACGGCTCCAAACTGGAAAGAGGCGTGCCCTCC<br>AGATTCTCCGGCTCTAGATGGGGCCAAGAGTACACCCTGACCATCTCTAGCCTGCAGCCTGAGGATATCGCCACATACTTTTGC<br>CAGGTGTACGAGTTCTTCGGCCCTGGCACCAGACTGGACCTGAAGAGAACAGTGGCCGCTCCTTCCGTGTTCATCTTCCCACCA<br>TCTGACGAGCAGCTGAAGTCTGGCACCGCTTCTGTCGTGTGCCTGCTGAACAACTTCTACCCTCGGGAAGCCAAGGTGCAGTGG<br>AAGGTGGACAATGCCCTGCAGTCCGGCAACTCCCAAGAGTCTGTGACCGAGCAGGACTCCAAGGACTCTACCTACAGCCTGTCC<br>TCCACACTGACCCTGTCTAAGGCCGACTACGAGAAGCACAAGGTGTACGCCTGCGAAGTGACCCATCAGGGACTGTCTAGCCCC<br>GTGACCAAGTCCTTCAACAGAGGCGAGTGT |
| 617 | GACATCCAGATGACACAGAGCCCTAGCAGCCTGTCTGCCTCTGTGGGCGATAGAGCCACAATCACCTGTCAGGCCAACGGCTAC<br>CTGAACTGGTATCAGCAGAGAAGAGGCAAGGCCCCTAAGCTGCTGATCTACGACGGCAGCAAACTGGAAAGAGGCGTGCCAAGC<br>AGATTCAGCGGCTCTAGATGGGGCCAAGAGTACACCCTGACCATCTCTAGCCTGCAGCCTGAGGATATCGCCACATACTTTTGC<br>CAGGTGTACGAGTTCTTCGGCCCTGGCACCAGACTGGACCTGAAACGTACGGTGGCTGCACCATCTGTCTTCATCTTCCCGCCA<br>TCTGATGAGCAGTTGAAATCTGGAACTGCCTCTGTTGTGTGCCTGCTGAATAACTTCTATCCCAGAGAGGCCAAAGTACAGTGG<br>AAGGTGGATAACGCCCTCCAATCGGGTAACTCCCAGGAGAGTGTCACAGAGCAGGACAGCAAGGACAGCACCTACAGCCTCAGC<br>AGCACCCTGACGCTGAGCAAAGCAGACTACGAGAAACACAAAGTCTACGCCTGCGAAGTCACCCATCAGGGCCTGAGCTCGCCC<br>GTCACAAAGAGCTTCAACAGGGGAGAGTGT |
| 618 | GACATCCAGATGACCCAGTCTCCATCCTCTCTGTCTGCCAGAGTGGGCGATACCGCTACCATCACCTGTCAGGCCAACGGCTAC<br>CTGAACTGGTATCAGCAGAGAAGAGGCAAGGCCCCTAAGCTGCTGATCTACGACGGCTCCAAACTGGAAAGAGGCGTGCCCGCT<br>AGATTCTCCGGCAGAAGATGGGGCCAAGAGTACACCCTGACCATCAACAACCTGCAGCCTGAGGACGTGGCCACATACTTTTGC<br>CAGGTGTACGAGTTCATCGTGCCCGGCACCAGACTGGACCTGAAGAGAACAGTTGCCGCTCCTTCCGTGTTCATCTTCCCACCT<br>TCCGACGAGCAGCTGAAGTCTGGCACAGCTTCTGTCGTGTGCCTGCTGAACAACTTCTACCCTCGGGAAGCCAAGGTGCAGTGG<br>AAGGTGGACAATGCCCTGCAGTCCGGCAACTCCCAAGAGTCTGTGACCGAGCAGGACTCCAAGGACTCTACCTACAGCCTGTCC<br>TCCACACTGACCCTGTCTAAGGCCGACTACGAGAAGCACAAGGTGTACGCCTGCGAAGTGACCCATCAGGGACTGTCTAGCCCC<br>GTGACCAAGTCCTTCAACAGAGGCGAGTGT |
| 619 | GATATTCAGATGACACAGAGCCCCAGTAGCCTGAGCGCCCGCGTGGGCGACACCGCGACCATCACCTGTCAGGCCAACGGCTAT<br>CTGAACTGGTATCAACAGAGGAGGGGCAAGGCCCCCAAGCTCCTGATATACGACGGCAGCAAGCTGGAGAGGGGCGTTCCCGCA<br>CGCTTCAGCGGCAGGAGGTGGGGCCAGGAGTACACCCTTACAATCAACAACCTGCAGCCCGAGGACGTCGCCACCTATTTCTGC<br>CAAGTTTACGAGTTCATCGTGCCCGGCACCAGGCTGGACCTGAAGCGGACCGTGGCCGCCCCAGCGTGTTCATCTTCCCTCCC<br>AGCGACGAGCAGCTGAAGTCTGGCACCGCCAGCGTGGTGTGCCTGCTGAACAACTTCTACCCCCGCGAGGCCAAGGTGCAGTGG<br>AAGGTGGACAACGCCCTGCAGAGCGGCAACAGCCAGGAGAGCGTGACCGAGCAGGACTCCAAGGACAGCACCTACAGCCTGAGC<br>AGCACCCTGACCCTGAGCAAGGCCGACTACGAGAAGCACAAGGTGTACGCCTGCGAGGTGACCCACCAGGGACTGTCTAGCCCC<br>GTGACCAAGAGCTTCAACCGGGGCGAGTGC |

Vectors and Host Cells

This disclosure also encompasses vectors comprising a nucleic acid(s) disclosed herein. A vector can be of any type, for example, a recombinant vector such as an expression vector. Vectors include, but are not limited to, plasmids, cosmids, bacterial artificial chromosomes (BAC) and yeast artificial chromosomes (YAC) and vectors derived from bacteriophages or plant or animal (including human)

viruses. Vectors can comprise an origin of replication recognized by the proposed host cell and in the case of expression vectors, promoter and other regulatory regions recognized by the host cell. In additional embodiments, a vector comprises a polynucleotide encoding an antibody of the disclosure operably linked to a promoter and optionally additional regulatory elements. Certain vectors are capable of autonomous replication in a host into which they are introduced (e.g., vectors having a bacterial origin of replication can replicate in bacteria). Other vectors can be integrated into the genome of a host upon introduction into the host, and thereby are replicated along with the host genome. Vectors include, but are not limited to, those suitable for recombinant production of the antibodies disclosed herein.

The choice of the vector is dependent on the recombinant procedures followed and the host used. Introduction of vectors into host cells can be effected by inter alia calcium phosphate transfection, virus infection, DEAE-dextran-mediated transfection, lipofectamine transfection or electroporation. Vectors may be autonomously replicating or may replicate together with the chromosome into which they have been integrated. In certain embodiments, the vectors contain one or more selection markers. The choice of the markers may depend on the host cells of choice. These include, but are not limited to, kanamycin, neomycin, puromycin, hygromycin, zeocin, thymidine kinase gene from Herpes simplex virus (HSV-TK), and dihydrofolate reductase gene from mouse (dhfr). Vectors comprising one or more nucleic acid molecules encoding the antibodies described herein, operably linked to one or more nucleic acid molecules encoding proteins or peptides that can be used to isolate the antibodies, are also covered by the disclosure. These proteins or peptides include, but are not limited to, glutathione-S-transferase, maltose binding protein, metal-binding polyhistidine, green fluorescent protein, luciferase and beta-galactosidase.

In other embodiments, the vector that is used is pcDNA™3.1+(ThermoFisher, MA).

The disclosure also provides host cells comprising a nucleic acid or a vector described herein. Any of a variety of host cells can be used. In one embodiment, a host cell is a prokaryotic cell, for example, *E. coli*. In another embodiment, a host cell is a eukaryotic cell, for example, a yeast cell, a plant cell (e.g., a tobacco plant cell), or a mammalian cell, such as a Chinese Hamster Ovary (CHO) cell (e.g., CHO-S,®, CHO-K1, CHO-K1a, CHO DG44, EXPICHO™), COS cells, BHK cells, NSO cells or Bowes melanoma cells. Examples of human host cells are, inter alia, HeLa, 911, AT1080, A549, 293 and HEK293 (e.g., HEK293E, HEK293T, EXPI293™) cells. In addition, antibodies (e.g., scFv's) can be expressed in a yeast cell such as *Pichia* (see, e.g., Powers et al., J Immunol Methods. 251: 123-35 (2001)), *Hanseula*, or *Saccharomyces*. Antibody production in transgenic tobacco plants and cultured plant cells is described, e.g., in Sacks, et al., *Plant Biotechnol J.* (2015) 13(8):1094-105; Klimyuk, et al., *Curr Top Microbiol Immunol.* (2014) 375:127-54 and Cramer, et al., *Curr Top Microbiol Immunol.* (1999) 240:95-118.

In some embodiments, the host cell predominantly sialylates N-linked glycosylation sites with the variable regions of an immunoglobulin antigen binding domain. In some embodiments, the polynucleotides encoding an antibody or antigen-binding fragment thereof, as described herein, are expressed in a host cell that sialylates at least 50%, at least 55%, at least 60%, at least 65%, at least 70%, at least 75%, at least 80%, at least 85%, at least 90%, at least 91%, at least 92%, at least 93%, at least 94%, at least 95%, or more, N-linked glycosylation sites in the variable domains (Fv, particularly VL) of expressed antibodies or antigen-binding fragments thereof. In some embodiments, the cell sialylates at least 50%, at least 60%, at least 70%, least 80%, at least 85%, at least 90%, at least 91%, at least 92%, at least 93%, at least 94%, at least 95%, or more, N-linked glycosylation sites in the VL of expressed antibodies or antigen-binding fragments. In some embodiments, the N-linked glycosylation sites in the VL have a sialic acid occupancy (e.g., a glycan comprising one or two terminal sialic acid residues) of at least 40%, at least 50%, at least 60%, at least 70%, least 80%, at least 85%, at least 90%, or more. As used herein, "occupancy" refers to the percentage of the time that a glycan is attached at a predicted amino acid glycosylation site. In some embodiments, the asparagine at VL amino acid position 72 according to Kabat numbering (N72) is sialylated. In some embodiments, the sialylated N-linked glycosylation sites in the VL comprise from 1 to 5 sialic acid residues, e.g., from 1 to 4 sialic acid residues, e.g., from 1 to 3 sialic acid residues, e.g., from 1 to 2 sialic acid residues. Human and hamster host cells predominantly sialylate with N-acetylneuraminic acid (NANA). In some embodiments, the VL are sialylated or predominantly sialylated with N-acetylneuraminic acid (NANA). Mouse host cells predominantly sialylate with N-glycolylneuraminic acid (NGNA). In some embodiments, the VL are sialylated or predominantly sialylated with N-acetylneuraminic acid (NGNA). In some embodiments, the sialic acid residues are present in biantennary structures. In some embodiments, the sialic acid residues are present in complex N-linked glycan structures (e.g., can contain almost any number of the other types of saccharides, including more than the original two N-acetylglucosamines). In some embodiments, the sialic acid residues are present in hybrid N-linked glycan structures (e.g., can contain mannose residues on one side of the branch, while on the other side a N-acetylglucosamine initiates a complex branch).

The term "nucleic acid molecule" refers to a polymeric form of nucleotides and includes both sense and anti-sense strands of RNA, cDNA, genomic DNA, and synthetic forms and mixed polymers of the above. As used herein, the term nucleic acid molecule may be interchangeable with the term polynucleotide. In some embodiments, a nucleotide refers to a ribonucleotide, deoxynucleotide or a modified form of either type of nucleotide, and combinations thereof. The terms also include, but are not limited to, single- and double-stranded forms of DNA. In addition, a polynucleotide, e.g., a cDNA or mRNA, may include either or both naturally occurring and modified nucleotides linked together by naturally occurring and/or non-naturally occurring nucleotide linkages. The nucleic acid molecules may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analogue, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.). The above term is also intended to include any topological conformation, including single-stranded, double-stranded, partially duplexed, triplex, hairpinned, circular and padlocked conformations. A reference to a nucleic acid sequence encompasses its complement unless otherwise specified. Thus, a reference to a nucleic acid molecule having a particular sequence should be understood to encompass its complementary strand, with its complementary sequence. The term also includes codon-optimized nucleic acids.

The term "operably linked" refers to two or more nucleic acid sequence elements that are usually physically linked and are in a functional relationship with each other. For instance, a promoter is operably linked to a coding sequence if the promoter is able to initiate or regulate the transcription or expression of a coding sequence, in which case, the coding sequence should be understood as being "under the control of" the promoter.

A "substitution," as used herein, denotes the replacement of one or more amino acids or nucleotides by different amino acids or nucleotides, respectively.

An "isolated" nucleic acid refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location. "Isolated nucleic acid encoding an antibody or fragment thereof" refers to one or more nucleic acid molecules encoding antibody heavy and light chains (or fragments thereof), including such nucleic acid molecule(s) in a single vector or separate vectors, and such nucleic acid molecule(s) present at one or more locations in a host cell.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Some vectors are suitable for delivering the nucleic acid molecule or polynucleotide of the present application. Certain vectors are capable of directing the expression of nucleic acids to which they are operatively linked. Such vectors are referred to herein as expression vectors.

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

A polynucleotide "variant," as the term is used herein, is a polynucleotide that typically differs from a polynucleotide specifically disclosed herein in one or more substitutions, deletions, additions and/or insertions. Such variants may be naturally occurring or may be synthetically generated, for example, by modifying one or more of the polynucleotide sequences of the invention and evaluating one or more biological activities of the encoded polypeptide as described herein and/or using any of a number of techniques well known in the art.

The term "variant" may also refer to any naturally occurring or engineered molecule comprising one or more nucleotide or amino acid mutations.

Further provided is a chimeric antigen receptor (CAR) including an antigen-binding antibody fragment as described herein. In certain embodiments, the CAR is expressed on a T-cell or a NK cell. Further provided is a CAR T-cell including a CAR as described herein. In certain embodiments, the T-cell is a CD4+ T-cell, a CD8+ T-cell, or a combination thereof. In certain embodiments, the cell is administered to a subject. In certain embodiments, the cell is autologous. In certain embodiments, the cell is allogeneic.

Methods of Producing Antibodies

Monospecific antibodies that bind to gp120 and bispecific antibodies that bind to gp120 and human CD3 (e.g., human CD3ε or human CD3δ) or to gp120 and CD89 can be produced by any method known in the art for the synthesis of antibodies, for example, by chemical synthesis or by recombinant expression techniques.

Methods of making monospecific antibodies are very well known in the art. Methods of making bispecific antibodies are described, for example, in U.S. Pat. Nos. 5,731,168; 5,807,706; 5,821,333; and U.S. Appl. Publ. Nos. 2003/020734 and 2002/0155537. Bispecific tetravalent antibodies, and methods of making them are described, e.g., in WO 02/096948 and WO 00/44788, the disclosures of both of which are herein incorporated by reference in its entirety. In addition, other publications relating to making bispecific antibodies include WO 91/00360, WO 92/08802, WO92/05793, and WO 93/17715; Tutt et al., *J. Immunol.* 147:60-69 (1991); U.S. Pat. Nos. 4,474,893; 4,714,681; 4,925,648; 5,573,920; 5,601,819 and 9,212,230; and Kostelny et al., *J. Immunol.* 148:1547-1553 (1992).

Another exemplary method of making bispecific antibodies is by the knobs-into-holes technology (Ridgway et al., *Protein Eng.*, 9:617-621 (1996); WO 2006/028936). The mispairing problem of Ig heavy chains that is a chief drawback for making bispecific antibodies is reduced in this technology by mutating selected amino acids forming the interface of the CH3 domains in IgG. At positions within the CH3 domain at which the two heavy chains interact directly, an amino acid with a small side chain (hole) is introduced into the sequence of one heavy chain and an amino acid with a large side chain (knob) into the counterpart interacting residue location on the other heavy chain. In some instances, antibodies of the disclosure have immunoglobulin chains in which the CH3 domains have been modified by mutating selected amino acids that interact at the interface between two polypeptides so as to preferentially form a bispecific antibody. The bispecific antibodies can be composed of immunoglobulin chains of the same subclass or different subclasses. In one instance, a bispecific antibody that binds to gp120 and CD3 comprises a T366W (EU numbering) mutation in the "knobs chain" and T366S, L368A, Y407V 9EU numbering) mutations in the "hole chain." In certain embodiments, an additional interchain disulfide bridge is introduced between the CH3 domains by, e.g., introducing a Y349C mutation into the "knobs chain" and a E356C mutation or a S354C mutation into the "hole chain." In certain embodiments, R409D, K370E mutations are introduced in the "knobs chain" and D399K, E357K mutations in the "hole chain." In other embodiments, Y349C, T366W mutations are introduced in one of the chains and E356C, T366S, L368A, Y407V mutations in the counterpart chain. In some embodiments. Y349C, T366W mutations are introduced in one chain and S354C, T366S, L368A, Y407V mutations in the counterpart chain. In some embodiments, Y349C, T366W mutations are introduced in one chain and S354C, T366S, L368A, Y407V mutations in the counterpart chain. In yet other embodiments, Y349C, T366W mutations are introduced in one chain and S354C, T366S, L368A, Y407V mutations in the counterpart chain (all EU numbering).

Another exemplary method of making bispecific antibodies is by using the Bispecific T-cell Engagers (BiTEs®) platform. BiTEs are made by genetically fusing a first scFv (e.g., an scFv that binds gp120) to a second scFv (e.g., an scFv that binds human CD3) via flexible peptide linker (e.g., GGGGS (SEQ ID NO: 429)). See, e.g., Staerz et al., *Nature*, 314:628-631 (1985); Mack et al., PNAS, 92:7021-7025 (1995); Huehls et al., *Immunol. Cell Biol.*, 93:290-296 (2015).

Another exemplary method of making bispecific antibodies is by using the Dual-Affinity Re-targeting (DART) platform. This technology is based on the diabody format of Holliger et al. (*PNAS*, 90:6444-6448 (1993)) and further improved for stability and optimal pairing of the VH and VL chains (Johnson et al., *J Mol. Biol.*, 399:436-449 (2010); Sung et al., *J Clin Invest.*, 125(11): 4077-4090 (2015)).

Yet another exemplary method of making bispecific antibodies is by using the Trifunctional Hybrid Antibodies platform—Triomab®. This platform employs a chimeric construction made up of half of two full-length antibodies of different isotypes, mouse IgG2a and rat IgG2b. This technology relies on species-preferential heavy/light chain pairing associations. See, Lindhofer et al., *J Immunol.*, 155:219-225 (1995).

A further exemplary method of making bispecific antibodies is by using the TandAb® platform. This technology is based on the diabody concept but are designed as a single polypeptide chain VH1-VL2-VH2-VL1 comprising short linkers to prevent intra-chain pairing. Head-to-tail dimerization of this single chain results in the formation of a tetravalent homodimer (Kipriyanov et al., *J Mol. Biol.*, 293:41-56 (1999)).

Yet another method for making bispecific antibodies is the CrossMab technology. CrossMab are chimeric antibodies constituted by the halves of two full-length antibodies. For correct chain pairing, it combines two technologies: (i) the knob-into-hole which favors a correct pairing between the two heavy chains; and (ii) an exchange between the heavy and light chains of one of the two Fabs to introduce an asymmetry which avoids light-chain mispairing. See, Ridgway et al., *Protein Eng.*, 9:617-621 (1996); Schaefer et al., *PNAS*, 108:11187-11192 (2011). CrossMabs can combine two or more antigen-binding domains for targeting two or more targets or for introducing bivalency towards one target such as the 2:1 format.

The antibodies of this disclosure may be produced in bacterial or eukaryotic cells. Antibodies can also be produced in eukaryotic cells such as transformed cell lines (e.g., CHO-based or CHO-origin cell lines (e.g., CHO-S, CHO DG44, EXPICHO™, CHOZN® ZFN-modified GS−/− CHO cell line, CHO-K1, CHO-K1a), 293E, 293T, COS, NIH3T3). In addition, antibodies (including antibody fragments, e.g., Fabs, scFv's) can be expressed in a yeast cell such as *Pichia* (see, e.g., Powers et al., *J Immunol Methods.* 251:123-35 (2001)), *Hanseula*, or *Saccharomyces*. In one embodiment, the antibodies described herein are produced in a CHO cell line, e.g., a CHO-S, CHO DG44, EXPICHO™, CHOZN®, CHO-K1 or CHO-K1a cell line. To produce the antibody of interest, a polynucleotide encoding the antibody is constructed, introduced into an expression vector, and then expressed in suitable host cells. Standard molecular biology techniques are used to prepare the recombinant expression vector, transfect the host cells, select for transformants, culture the host cells, and recover the antibody.

If the antibody is to be expressed in bacterial cells (e.g., *E. coli*), the expression vector should have characteristics that permit amplification of the vector in the bacterial cells. Additionally, when *E. coli* such as JM109, DH5α, HB101, or XL1-Blue is used as a host, the vector must have a promoter, for example, a lacZ promoter (Ward et al., 341: 544-546 (1989), araB promoter (Better et al., *Science*, 240:1041-1043 (1988)), or T7 promoter that can allow efficient expression in *E. coli*. Examples of such vectors include, for example, M13-series vectors, pUC-series vectors, pBR322, pBluescript, pCR-Script, pGEX-5X-1 (Pharmacia), "QIAexpress system" (QIAGEN), pEGFP, and pET (when this expression vector is used, the host is preferably BL21 expressing T7 RNA polymerase). The expression vector may contain a signal sequence for antibody secretion. For production into the periplasm of *E. coli*, the pelB signal sequence (Lei et al., *J. Bacteriol.*, 169:4379 (1987)) may be used as the signal sequence for antibody secretion. For bacterial expression, calcium chloride methods or electroporation methods may be used to introduce the expression vector into the bacterial cell.

If the antibody is to be expressed in animal cells such as CHO, CHO-S, CHO DG44, CHOZN®, EXPICHO™, CHO-K1, CHO-K1a, COS, and NIH3T3 cells, the expression vector includes a promoter necessary for expression in these cells, for example, an SV40 promoter (Mulligan et al., *Nature*, 277:108 (1979)), MMLV-LTR promoter, EF1α promoter (Mizushima et al., *Nucleic Acids Res.*, 18:5322 (1990)), or CMV promoter. In addition to the nucleic acid sequence encoding the immunoglobulin or domain thereof, the recombinant expression vectors may carry additional sequences, such as sequences that regulate replication of the vector in host cells (e.g., origins of replication) and selectable marker genes. The selectable marker gene facilitates selection of host cells into which the vector has been introduced (see e.g., U.S. Pat. Nos. 4,399,216, 4,634,665 and 5,179,017). For example, typically the selectable marker gene confers resistance to drugs, such as G418, hygromycin, or methotrexate, on a host cell into which the vector has been introduced. Examples of vectors with selectable markers include pMAM, pDR2, pBK-RSV, pBK-CMV, pOPRSV, and pOP13.

In one embodiment, antibodies are produced in mammalian cells. Exemplary mammalian host cells for expressing an antibody include Chinese Hamster Ovary (CHO cells, including, e.g., CHO-S, CHO DG44, EXPICHO™, CHOZN®, CHO-K1 or CHO-K1a cells) (including dhfr⁻ CHO cells, described in Urlaub and Chasin (1980) *Proc. Natl. Acad. Sci. USA* 77:4216-4220, used with a DHFR selectable marker, e.g., as described in Kaufman and Sharp (1982) *Mol. Biol.* 159:601-621), human embryonic kidney 293 cells (e.g., 293, 293E, 293T), COS cells, NIH3T3 cells, human B-cells, lymphocytic cell lines, e.g., NSO myeloma cells and SP2 cells, and a cell from a transgenic animal, e.g., a transgenic mammal. For example, in some embodiments, the cell is a mammary epithelial cell.

In an exemplary system for antibody expression, recombinant expression vectors encoding the antibody heavy chain and the antibody light chain of an antibody of this disclosure are introduced into dhfr⁻ CHO cells by calcium phosphate-mediated transfection. In a specific embodiment, the dhfr⁻ CHO cells are cells of the DG44 cell line, such as DG44i (see, e.g., Derouaz et al., *Biochem Biophys Res Commun.*, 340(4):1069-77 (2006)). Within the recombinant expression vectors, the antibody heavy and light chain genes are each operatively linked to enhancer/promoter regulatory elements (e.g., derived from SV40, CMV, adenovirus and the like, such as a CMV enhancer/AdMLP promoter regulatory element or an SV40 enhancer/AdMLP promoter regulatory element) to drive high levels of transcription of the genes. The recombinant expression vectors also carry a DHFR gene, which allows for selection of CHO cells that have been transfected with the vector using methotrexate selection/amplification. The selected transformant host cells are cultured to allow for expression of the antibody heavy and light chains and the antibody is recovered from the culture medium.

Antibodies can also be produced by a transgenic animal. For example, U.S. Pat. No. 5,849,992 describes a method of expressing an antibody in the mammary gland of a transgenic mammal. A transgene is constructed that includes a milk-specific promoter and nucleic acids encoding the antibody of interest and a signal sequence for secretion. The milk produced by females of such transgenic mammals includes, secreted-therein, the antibody of interest. The antibody can be purified from the milk, or for some applications, used directly. Animals are also provided comprising one or more of the nucleic acids described herein.

The antibodies of the present disclosure can be isolated from inside or outside (such as medium) of the host cell and purified as substantially pure and homogenous antibodies. Methods for isolation and purification commonly used for antibody purification may be used for the isolation and purification of antibodies, and are not limited to any particular method. Antibodies may be isolated and purified by appropriately selecting and combining, for example, column chromatography, filtration, ultrafiltration, salting out, solvent precipitation, solvent extraction, distillation, immunoprecipitation, SDS-polyacrylamide gel electrophoresis, isoelectric focusing, dialysis, and recrystallization. Chromatography includes, for example, affinity chromatography, ion exchange chromatography, hydrophobic chromatography, gel filtration, reverse-phase chromatography, and adsorption chromatography (Strategies for Protein Purification and Characterization: A Laboratory Course Manual. Ed Daniel R. Marshak et al., Cold Spring Harbor Laboratory Press, 1996). Chromatography can be carried out using liquid phase chromatography such as HPLC and FPLC. Columns used for affinity chromatography include protein A column and protein G column. Examples of columns using protein A column include Hyper D, POROS, and Sepharose FF (GE Healthcare Biosciences). The present disclosure also includes antibodies that are highly purified using these purification methods.

Pharmaceutical Compositions

This disclosure also includes pharmaceutical compositions comprising an antibody described herein, or a polynucleotide encoding an antibody described herein, and a pharmaceutically acceptable diluent, carrier or excipient. In certain embodiments, the pharmaceutical composition comprises a therapeutically effective amount of the antibody or polynucleotide.

Various pharmaceutically acceptable diluents, carriers, and excipients, and techniques for the preparation and use of pharmaceutical compositions will be known to those of skill in the art in light of the present disclosure. Illustrative pharmaceutical compositions and pharmaceutically acceptable diluents, carriers, and excipients are also described in Remington: The Science and Practice of Pharmacy 20th Ed. (Lippincott, Williams & Wilkins 2003); Loyd V. Allen Jr (Editor), "Remington: The Science and Practice of Pharmacy," 22$^{nd}$ Edition, 2012, Pharmaceutical Press; Brunton, Knollman and Hilal-Dandan, "Goodman and Gilman's The Pharmacological Basis of Therapeutics," 13th Edition, 2017, McGraw-Hill Education/Medical; McNally and Hastedt (Editors), "Protein Formulation and Delivery, 2nd Edition, 2007, CRC Press; Banga, "Therapeutic Peptides and Proteins: Formulation, Processing, and Delivery Systems," 3rd Edition, 2015, CRC Press; Lars Hovgaard, Frokjaer and van de Weert (Editors), "Pharmaceutical Formulation Development of Peptides and Proteins," 2nd Edition, 2012, CRC Press; Carpenter and Manning (Editors), "Rational Design of Stable Protein Formulations: Theory and Practice," 2002, Springer (Pharmaceutical Biotechnology (Book 13)); Meyer (Editor), "Therapeutic Protein Drug Products: Practical Approaches to Formulation in the Laboratory, Manufacturing, and the Clinic, 2012, Woodhead Publishing; and Shire, "Monoclonal Antibodies: Meeting the Challenges in Manufacturing, Formulation, Delivery and Stability of Final Drug Product, 2015, Woodhead Publishing.

In some embodiments, each carrier, diluent or excipient is "acceptable" in the sense of being compatible with the other ingredients of the pharmaceutical composition and not injurious to the subject. Often, the pharmaceutically acceptable carrier is an aqueous pH-buffered solution. Some examples of materials which can serve as pharmaceutically-acceptable carriers, diluents or excipients include: sterile water; buffers, e.g., phosphate-buffered saline; sugars, such as lactose, glucose, trehalose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; phosphate buffer solutions; amino acids (e.g., charged amino acids, including without limitation, aspartate, asparagine, glutamate, glutamine, histidine, lysine); and other non-toxic compatible substances employed in pharmaceutical formulations. Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

The formulation of and delivery methods of pharmaceutical compositions will generally be adapted according to the site and the disease to be treated. Exemplary formulations include, but are not limited to, those suitable for parenteral administration, e.g., intravenous, intra-arterial, intramuscular, or subcutaneous administration, including formulations encapsulated in micelles, liposomes or drug-release capsules (active agents incorporated within a biocompatible coating designed for slow-release); ingestible formulations; formulations for topical use, such as creams, ointments and gels; and other formulations such as inhalants, aerosols and sprays.

Methods of Use

This disclosure provides methods for treating or preventing an HIV infection or a related disease or disorder in a subject in need thereof (e.g., a human subject), comprising providing to a subject in need thereof an effective amount of an antibody or antibodies described herein, or a polynucleotide encoding the antibody or antibodies. As used herein, the term "effective amount" in the context of the administration of a therapy to a subject refers to the amount of a therapy that achieves a desired prophylactic or therapeutic effect. The polynucleotide may be present in a vector, e.g., a viral vector. In some embodiments, the related disease or disorder is caused by infection with HIV. In other embodiments, it is acquired immune deficiency syndrome (AIDS). In certain embodiments, the subject is a virologically suppressed HIV-infected mammal, while in other embodiments, the subject is a treatment-naïve HIV-infected mammal. In certain embodiments, a treatment-naïve subject has a viral load between $10^3$ and $10^5$ copies/ml, and in certain embodiments, a virologically suppressed subject has a viral load <50 copies/ml. In another embodiment, the subject is a mammal, e.g., a human. In certain embodiments, the subject has been diagnosed with an HIV, e.g., HIV-1 or HIV-2, infection or a related disease or disorder, e.g., AIDS, or is considered at risk for developing an HIV, e.g., HIV-1 or HIV-2, infection or a related disease or disorder, e.g., AIDS. Subjects at risk for HIV-related diseases or disorders include patients who have come into contact with an infected person or who have been exposed to HIV in some other way. Administration of a prophylactic agent can occur prior to the manifestation of symptoms characteristic of HIV-related disease or disorder, such that a disease or disorder is prevented or, alternatively, delayed in its progression. In certain embodiments, the antibody or antigen-binding fragment thereof comprises VH CDRs and VL CDRs having the sequences set forth in: SEQ ID NOs.: 137, 138, 139, 140, 141, and 142, respectively. In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278. In certain embodiments, the antibody or antigen-binding fragment thereof comprises a VH sequence set forth in SEQ ID NO: 477 and a VL sequence set forth in SEQ ID NO: 278. In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a heavy chain that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 529 and a light chain that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 103. In certain embodiments, the antibody or antigen-binding fragment thereof comprises a heavy chain sequence set forth in SEQ ID NO: 529 and a light chain sequence set forth in SEQ ID NO: 103.

Also provided are methods for preventing or inhibiting an increase in HIV virus titer, virus replication, virus proliferation or an amount of an HIV viral DNA, HIV proviral DNA, or HIV viral protein in a subject (e.g., a human subject). In one embodiment, the method comprises providing to the subject in need thereof an amount of an antibody or antibodies (or their antigen-binding fragments) described herein, or a polynucleotide encoding the antibody or antibodies (or their antigen-binding fragments), effective to prevent an increase in HIV titer, virus replication, or an amount of an HIV protein of one or more HIV strains or isolates in the subject. In certain embodiments, the method further comprises measuring an amount of HIV viral or proviral DNA or protein at one or more time points, e.g., before and after the subject in provided with an antibody or antibodies of the present disclosure. Methods and biomarkers for determining an amount of HIV viral or proviral DNA or protein in a subject are known and available in the art, and described for example, in Siliciano, J. D. et al., *Curr Opin. HIV AIDS,* 5(6):491-7 (2010), and Rouzioux, C. et al., *Curr Opin HIV AIDS,* 8(3):170-5 (2013).

In certain aspect, an antibody or antibodies of the present disclosure may be used in, for example, methods of inhibiting certain viruses such as HIV isolates described herein, prophylactic inhibiting or preventing infections of certain viruses such as HIV isolates described herein, detection of certain viruses such as HIV isolates described herein in a sample, inhibiting certain viruses such as HIV isolates described herein, or diagnosis of certain viruses such as HIV isolates described herein.

For in vivo treatment of mammalian subject, e.g., humans, the subject may be administered or provided a pharmaceutical composition comprising an antibody or antibodies described herein. When used for in vivo therapy, an antibody or antibodies described herein are typically administered or provided to the patient in therapeutically effective amounts (i.e., amounts that eliminate or reduce the patient's viral burden and/or viral reservoir). The antibodies are administered or provided to a mammalian subject, e.g., a human, in accord with known methods, such as, but not limited to, intravenous administration, e.g., as a bolus or by continuous infusion over a period of time, by intramuscular, intraperitoneal, intracerebrospinal, subcutaneous, intraarticular, intrasynovial, intrathecal, oral, topical, or inhalation routes. The antibodies may be administered parenterally, when possible, at the target cell site, or intravenously. In one embodiment, administration of the antibody or antibodies to the subject is via an intravenous route. In another embodiment, administration of the antibody or antibodies to the subject is via a subcutaneous route. In additional embodiments, pharmaceutical compositions of the disclosure are administered to a subject systemically, parenterally, or locally.

In certain embodiments, the present disclosure provides a method for treating an HIV infection, comprising administering to a human subject in need thereof a therapeutically effective amount of an antibody or antibodies disclosed herein. In some embodiments, the present disclosure provides a method for preventing an HIV infection, comprising administering to a human subject in need thereof a therapeutically effective amount of an antibody or antibodies disclosed herein.

Combination Therapy

In certain embodiments, this disclosure provides a method for treating (e.g., including long-term or extended suppression) or preventing an HIV infection in a human subject having, or at risk of having, the HIV infection. The method comprises administering to the human subject a therapeutically effective amount of an antibody or antibodies disclosed herein, or a pharmaceutical composition thereof, in combination with a therapeutically effective amount of one or more (e.g., one, two, three, one or two, or one to three) additional therapeutic agents. In certain embodiments, the antibody or antigen-binding fragment thereof comprises VH CDRs and VL CDRs having the sequences set forth in: SEQ ID NOs.: 137, 138, 139, 140, 141, and 142, respectively. In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278. In certain embodiments, the antibody or antigen-binding fragment thereof comprises a VH sequence set forth in SEQ ID NO: 477 and a VL sequence set forth in SEQ ID NO: 278. In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a heavy chain that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 529 and a light chain that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 103. In certain embodiments, the antibody or antigen-binding fragment thereof comprises a heavy chain sequence set forth in SEQ ID NO: 529 and a light chain sequence set forth in SEQ ID NO: 103. In one embodiment, a method for treating an HIV infection in a human subject having or at risk of having the infection is provided, the method comprising administering to the human subject a therapeutically effective amount of an antibody or antibodies disclosed herein, or a pharmaceutically acceptable salt thereof, in combination with a therapeutically effective amount of one or more (e.g., one, two, three, one or two, or one to three) additional therapeutic agents. In some embodiments, after one or more administrations of the antibody or antigen-binding fragments thereof, optionally with one or more additional therapeutic agents, the subject does not exhibit symptoms of HIV or AIDS in the absence of anti-retroviral treatment (ART) for at least 6 months, at least 1 year, at least 2 years, at least 3 years, or more. In some embodiments, after one or more administrations of the binding molecule, the subject has a viral load of copies/ml blood of less than 500, e.g., less than 400, less than 300, less than 200, less than 100, less than 50, in the absence of anti-retroviral treatment (ART) for at least 6 months, at least 1 year, at least 2 years, at least 3 years, or more.

Multiple clinical studies have now shown that treatment of HIV infected individuals with single broadly neutralizing antibodies (bNAbs) leads to temporary suppression of sensitive viruses, followed by rapid outgrowth of resistant viruses—many of which appear to be rare pre-existing viral variants.

Antibody A and Antibody B were previously shown to neutralize 96% of 118 cross-clade viruses tested in vitro (Scheid et al., Science, 333: 1633-1637 (2011)). The clinical trials showed that many HIV infected patients receiving the antibody treatment exhibited rare and pre-existing resistant clones, even when their plasma HIV isolates appeared to be sensitive to the antibody (Caskey et al., Nature, 522:487-491 (2016); Scheid et al., Nature, 535:556-560 (2016)). These results suggested that Antibody A may be broad when tested against HIV isolates collected from different patients (inter-patient bread), yet it may not neutralize 100% of viral isolates within individual patients (intra-patient breadth).

An antibody known as 10-1074, part of the PGT121 lineage and taken from the same donor and with similar neutralizing breadth, has also been tested in clinical trials (Mouquet et al., PNAS, 109:E3268-3277 (2012); Caskey et al., Nature Medicine, 23:185-191 (2017)). 10-1074 was originally shown to neutralize approximately 66% of 60 viruses tested at an IC50 below 50 µg/mL (Mouquet et al., PNAS (supra)). The 10-1074 trials showed that in many patients received 10-1074 therapy, there were resistant clones, even when the plasma HIV isolates appeared to be sensitive to the antibody (Caskey et al. Nature Medicine (supra)). This data suggests that most patients may harbor rare pre-existing viral variants that are resistant to 10-1074. These 10-1074 resistance variants showed correlated cross-resistance to PGT121, consistent with close evolutionary relationship between 10-1074 and PGT121. However, nearly all of the resistant viruses isolated during the 10-1074 clinical trial were sensitive to neutralization by Antibody A (Caskey et al. (supra). This data suggests that combination antibody therapy, using complementary bNAbs, may allow for more complete intra-patient viral coverage.

The bNAb combinations may achieve complete intra-patient viral coverage. In some embodiments, the combination therapy includes an antibody having the same CDRs, VH, VL, VH and VL, heavy, light, or heavy and light chains of any of the antibodies disclosed herein and another anti-HIV bNAbs antibody (i.e., a neutralizing antibody that neutralizes multiple HIV-1 viral strains). Various bNAbs are known in the art and may be used in this invention. Examples include, but are not limited to, those described in U.S. Pat. Nos. 8,673,307, 9,493,549, 9,783,594, WO2014/063059, WO2012/158948, WO2015/117008, and PCT/US2015/41272, and WO2017/096221, including antibodies 12A12, 12A21, NIH45-46, bANC131, 8ANC134, D32530, INC9, 8ANC195. 8ANC196, 10-259, 10-303, 10-410, 10-847, 10-996, 10-1074, 10-1121, 10-1130, 10-1146, 10-1341, 10-1369, and 10-1074GM. Additional examples include those described in Klein et al., *Nature*, 492(7427): 118-22 (2012), Horwitz et al., *Proc Natl Acad Sci USA*, 110(41): 16538-43 (2013), Scheid, et al., *Science*, 333: 1633-1637 (2011), Scheid, et al., *Nature*, 458:636-640 (2009), Eroshkin et al, *Nucleic Acids Res.*, 42 (Database issue):D1 133-9 (2014), Mascola et al., *Immunol Rev.*, 254 (1):225-44 (2013), such as 2F5, 4E10, M66.6, CAP206-CH12, 10E81 (all of which bind the MPER of gp41); PG9, PG16, CH01-04 (all of which bind V1V2-glycan), 2G12 (which binds to outer domain glycan); b12, HJ16, CH103-106, VRC01-03, VRC-PG04, 04b, VRC-CH30-34, 3BNC62, 3BNC89, 3BNC91, 3BNC95, 3BNC104, 3BNC176, and 8ANC131 (all of which bind to the CD4 binding site).

In some embodiments, the antibodies or antigen-binding fragments thereof, described herein, are combined or co-administered with a second antibody or antigen-binding fragment thereof (e.g., a second non-competing broadly neutralizing antibody (bNAb)) that binds to an epitope or region of gp120 selected from the group consisting of: (i) third variable loop (V3) and/or high mannose patch comprising a N332 oligomannose glycan; (ii) second variable loop (V2) and/or Env trimer apex; (iii) gp120/gp41 interface; or (iv) silent face of gp120. The foregoing epitopes or regions of gp120 bound by broadly neutralizing antibodies are described, e.g., in McCoy, Retrovirology (2018) 15:70; Sok and Burton, Nat Immunol. 2018 19(11):1179-1188; Possas, et al., Expert Opin Ther Pat. 2018 July; 28(7):551-560; and Stephenson and Barouch, Curr HIV/AIDS Rep (2016) 13:31-37, which are hereby incorporated herein by reference in their entirety for all purposes.

In some embodiments, the antibodies or antigen-binding fragments thereof, described herein, are combined or co-administered with a second antibody or antigen-binding fragment thereof (e.g., a second non-competing broadly neutralizing antibody (bNAb) that binds to an epitope or region of gp120 in the third variable loop (V3) and/or high mannose patch comprising a N332 oligomannose glycan and competes with or comprises VH and VL regions from an antibody selected from the group consisting of GS-9722, PGT-121.60, PGT-121.66, PGT-121, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. Additional broadly neutralizing antibodies that bind to gp120 in the third variable loop (V3) and/or high mannose patch comprising a N332 oligomannose glycan and which can be used as the second antibody or antigen-binding fragment thereof are described, e.g., in WO 2012/030904; WO 2014/063059; WO 2016/149698; WO 2017/106346; WO 2018/075564, WO 2018/125813 and WO 2018/237148, which are hereby incorporated herein by reference in their entireties for all purposes.

In some embodiments, the combination therapy includes an antibody having the same CDRs, VH, VL, VH and VL, heavy, light, or heavy and light chains of any of the antibodies disclosed herein and another anti-HIV antibody (e.g., GS-9722, PGT-121.60, PGT-121.66, PGT-121, PGT-122, PGT-123, PGT-124, PGT-133, or PGT-134) having the same CDRs, VH, VL, VH and VL, heavy, light, or heavy and light chains of any of the antibodies from Tables 1 and 2 of US2017/0190763A1. These improved or optimized versions of PGT121 have enhanced drug-like-properties, reduced immunogenicity, enhanced ADCC, and suitable pharmacokinetic properties. Such antibodies were shown to bind to the HIV envelope glycoprotein expressed on the surface of virion or infected cells, and mediating both direct neutralization of the virus as well as potent NK, Monocyte and PBMC killing of these cells. This property allows the antibodies to treat HIV infections by neutralizing the virus, and also kill and eliminate latently HIV infected cells in infected individuals, potentially leading to a sterilizing cure for HIV.

In one embodiment, the combination therapy includes an antibody having the same CDRs, VH, VL, VH and VL, heavy, light, or heavy and light chains of any of the antibodies disclosed herein and an antibody having the same CDRs, VH, VL, VH and VL, heavy, light, or heavy and light chains of the antibody having the sequences below:

| | |
|---|---|
| Heavy Chain (VH underlined) | QMQLQESGPGLVKPSETLSLTCSVSGASISDSYWSWIRRSPG KGLEWIGYVHKSGDTNYNPSLKSRVHLSLDTSKNQVSLSLTG VTAADSGKYYCARTLHGRRIYGIVAFNEWFTYFYMDVWGTGT QVTVSSASTKGPSVFPLAPSSKSTSGGTAALGCLVKDYFPEP VTVSWNSGALTSGVHTFPAVLQSSGLYSLSSVVTVPSSSLGT QTYICNVNHKPSNTKVDKKVEPKSCDKTHTCPPCPAPELLAG PDVFLFPPKPKDTLMISRTPEVTCVVVDVSHEDPEVKFNWYV DGVEVHNAKTKPREEQYNSTYRVVSVLTVLHQDWLNGKEYKC KVSNKALPLPEEKTISKAKGQPREPQVYTLPPSREEMTKNQV SLTCLVKGFYPSDIAVEWESNGQPENNYKTTPPVLDSDGSFF LYSKLTVDKSRWQQGNVFSCSVLHEALHSHYTQKSLSLSPGK (SEQ ID NO: 443) |
| Heavy CDR1 Kabat | DSYWS (SEQ ID NO: 444) |
| Heavy CDR2 Kabat | YVHKSGDTNYNPSLKS (SEQ ID NO: 445) |
| Heavy CDR3 Kabat | TLHGRRIYGIVAFNEWFTYFYMDV (SEQ ID NO: 446) |
| Light Chain (VL underlined) | SDISVAPGETARISCGEKSLGSRAVQWYQHRAGQAPSLIIYN NQDRPSGIPERFSGSPDSRPGTTATLTITSVEAGDEADYYCH IWDSRVPTKWVFGGGTTLTVLGQPKAAPSVTLFPPSSEELQA NKATLVCLISDFYPGAVTVAWKADSSPVKAGVETTTPSKQSN NKYAASSYLSLTPEQWKSHRSYSCQVTHEGSTVEK TVAPTECS (SEQ ID NO: 447) |
| Light CDR1 Kabat | GEKSLGSRAVQ (SEQ ID NO: 448) |
| Light CDR2 Kabat | NNQDRPS (SEQ ID NO: 449) |
| Light CDR3 Kabat | HIWDSRVPTKWV (SEQ ID NO: 450) |

In one embodiment, the combination therapy includes an antibody having the same CDRs, VH, VL, VH and VL, heavy, light, or heavy and light chains of any of the antibodies disclosed herein and an antibody having the same CDRs, VH, VL, VH and VL, heavy, light, or heavy and light chains of other additional anti-HIV antibodies such as those disclosed in US2017/0190763. In certain embodiments, the additional anti-HIV antibodies comprise an antibody comprising the VH (or heavy) and the VL (or light) chains provided below:

Heavy Chain (VH underlined):
(SEQ ID NO: 454)
QMQLQESGPGLVKPSETLSLTCSVSGASISDSYWSWIRRSPGKGLEWIGY

VHKSGDTNYNPSLKSRVHLSLDTSKNQVSLSLTGVTAADSGKYYCARTLH

GRRIYGIVAFNEWFTYFYMDVWGTGTQVTVSSASTKGPSVFPLAPSSKST

SGGTAALGCLVKDYFPEPVTVSWNSGALTSGVHTFPAVLQSSGLYSLSSV

VTVPSSSLGTQTYICNVNHKPSNTKVDKKVEPKSCDKTHTCPPCPAPELL

AGPDVFLFPPKPKDTLMISRTPEVTCVVVDVSHEDPEVKFNWYVDGVEVH

NAKTKPREEQYNSTYRVVSVLTVLHQDWLNGKEYKCKVSNKALPLPEEKT

ISKAKGQPREPQVYTLPPSREEMTKNQVSLTCLVKGFYPSDIAVEWESNG

QPENNYKTTPPVLDSDGSFFLYSKLTVDKSRWQQGNVFSCSVLHEALHSH

YTQKSLSLSPGK

Light Chain (VL underlined):
(SEQ ID NO: 455)
SDISVAPGETARISCGEKSLGSRAVQWYQHRAGQAPSLITYNNQDRPSGI

PERFSGSPDYRPGTTATLTITSVEAGDEADYYCHIWDSRVPTKWVFGGGT

TLTVLGQPKAAPSVTLFPPSSEELQANKATLVCLISDFYPGAVTVAWKAD

SSPVKAGVETTTPSKQSNNKYAASSYLSLTPEQWKSHRSYSCQVTHEGST

VEKTVAPTECS

In one embodiment, the combination therapy includes an antibody having the same CDRs, VH, VL, VH and VL, heavy, light, or heavy and light chains of any of the antibodies disclosed herein and an antibody having the same CDRs, VH, VL, VH and VL, heavy, light, or heavy and light chains of another anti-HIV antibody, the heavy chain of which has the amino acid sequence set forth in SEQ ID NO:40 and the light chain of which has the sequence provided below:

Light Chain (VL underlined):
(SEQ ID NO: 456)
SDISVAPGETARISCGEKSLGSRAVQWYQHRAGQAPSLIIYNNQDRPSGI

PERFSGSPDFRPGTTATLTITSVEAGDEADYYCHIWDSRVPTKWVFGGGT

TLTVLGQPKAAPSVTLFPPSSEELQANKATLVCLISDFYPGAVTVAWKAD

SSPVKAGVETTTPSKQSNNKYAASSYLSLTPEQWKSHRSYSCQVTHEGST

VEKTVAPTECS

In one embodiment, the combination therapy includes an antibody having the same CDRs, VH, VL, VH and VL, heavy, light, or heavy and light chains of any of the antibodies disclosed herein and an antibody having the same CDRs, VH, VL, VH and VL, heavy, light, or heavy and light chains of the antibody described below:

| Clone Designation | PGT121.42 hIgG1/hLambda |
|---|---|
| Heavy Chain (VH underlined) | QMQLQESGPGLVKPSETLSLTCSVSGASISDSYWSWIRRSPG KGLEWIGYVHKSGDTNYNPSLKSRVHLSLDTSKNQVSLSLSS VTAADSGKYYCARTLHGRRIYGIVAFNEWFTYFYMDVWGKGT QVTVSSASTKGPSVFPLAPSSKSTSGGTAALGCLVKDYFPEP VTVSWNSGALTSGVHTFPAVLQSSGLYSLSSVVTVPSSSLGT QTYICNVNHKPSNTKVDKKVEPKSCDKTHTCPPCPAPELLAG PDVFLFPPKPKDTLMISRTPEVTCVVVDVSHEDPEVKFNWYV DGVEVHNAKTKPREEQYNSTYRVVSVLTVLHQDWLNGKEYKC KVSNKALPLPEEKTISKAKGQPREPQVYTLPPSREEMTKNQV SLTCLVKGFYPSDIAVEWESNGQPENNYKTTPPVLDSDGSFF LYSKLTVDKSRWQQGNVFSCSVLHEALHSHYTQKSLSLSPGK (SEQ ID NO: 451) |
| Heavy CDR1 Kabat | DSYWS (SEQ ID NO: 444) |
| Heavy CDR2 Kabat | YVHKSGDTNYNPSLKS (SEQ ID NO: 445) |
| Heavy CDR3 Kabat | TLHGRRIYGIVAFNEWFTYFYMDV (SEQ ID NO: 446) |
| Light Chain (VL underlined) | SDISVAPGETARISCGEKSLGSRAVQWYQHRAGQAPSLIIYN NQDRPSGIPERFSGSPDSPFGTTATLTITSVEAGDEADYYCH IWDSRVPTKWVFGGGTTLTVLGQPKAAPSVTLFPPSSEELQA NKATLVCLISDFYPGAVTVAWKADSSPVKAGVETTTPSKQSN NKYAASSYLSLTPEQWKSHRSYSCQVTHEGSTVEKTVAPTEC S (SEQ ID NO: 452) |

| Clone Designation | PGT121.42 hIgG1/hLambda |
|---|---|
| Light CDR1 Kabat | GEKSLGSRAVQ (SEQ ID NO: 448) |
| Light CDR2 Kabat | NNQDRPS (SEQ ID NO: 449) |
| Light CDR3 Kabat | HIWDSRVPTKWV (SEQ ID NO: 450) |

In some embodiments, the antibodies or antigen-binding fragments thereof, described herein, are combined or co-administered with a second antibody or antigen-binding fragment thereof (e.g., a second non-competing broadly neutralizing antibody (bNAb)) that binds to an epitope or region of gp120 in the second variable loop (V2) and/or Env trimer apex and competes with or comprises VH and VL regions from an antibody selected from the group consisting of PG9, PG16, PGC14, PGG14, PGT-142, PGT-143, PGT-144, PGT-145, CH01, CH59, PGDM1400, CAP256, CAP256-VRC26.08, CAP256-VRC26.09, CAP256-VRC26.25, PCT64-24E and VRC38.01. Additional broadly neutralizing antibodies that bind to gp120 in the second variable loop (V2) and/or Env trimer apex and which can be used as the second antibody or antigen-binding fragment thereof are described, e.g., in WO 2010/107939; WO 2012/030904; WO 2018/075564 and WO 2018/125813, which are hereby incorporated herein by reference in their entireties for all purposes.

In some embodiments, the antibodies or antigen-binding fragments thereof, described herein, are combined or co-administered with a second antibody or antigen-binding fragment thereof (e.g., a second non-competing broadly neutralizing antibody (bNAb)) that binds to an epitope or region of gp120 in the gp120/gp41 interface and competes with or comprises VH and VL regions from an antibody selected from the group consisting of PGT-151, CAP248-2B, 35O22, 8ANC195, ACS202, VRC34 and VRC34.01. Additional broadly neutralizing antibodies that bind to gp120 in the gp120/gp41 interface and which can be used as the second antibody or antigen-binding fragment thereof are described, e.g., in WO 2011/038290; WO 2012/030904 and WO2017/079479, which are hereby incorporated herein by reference in their entireties for all purposes.

In some embodiments, the antibodies or antigen-binding fragments thereof, described herein, are combined or co-administered with a second antibody or antigen-binding fragment thereof (e.g., a second non-competing broadly neutralizing antibody (bNAb)) that binds to an epitope or region of the gp120 silent face and competes with or comprises VH and VL regions from an antibody selected from the group consisting of VRC-PG05 and SF12. See, e.g., Schoofs, et al., "Broad and Potent Neutralizing Antibodies Recognize the Silent Face of the HIV Envelope," *Immunity* (2019) May 14. pii: S1074-7613(19)30194-3 (PMID 31126879).

In some embodiments, the antibodies or antigen-binding fragments thereof, described herein, are combined or co-administered with a second antibody or antigen-binding fragment thereof (e.g., a second non-competing broadly neutralizing antibody (bNAb)) that binds to an epitope or region of gp41 in the membrane proximal region (MPER). Additional broadly neutralizing antibodies that bind to gp41 in the MPER and which can be used as the second antibody or antigen-binding fragment thereof are described, e.g., in WO 2011/034582; WO 2011/038290; WO 2011/046623 and WO 2013/070776, which are hereby incorporated herein by reference in their entireties for all purposes.

In some embodiments, the antibodies or antigen-binding fragments thereof, described herein, are combined or co-administered with a second antibody or antigen-binding fragment thereof (e.g., a second non-competing broadly neutralizing antibody (bNAb)) that binds to an epitope or region of gp41 in the membrane proximal region (MPER) and competes with or comprises VH and VL regions from an antibody selected from the group consisting of 10E8, 10E8v4, 10E8-5R-100cF, 4E10, DH511.11P, 2F5, 7b2, and LN01.

In some embodiments, the antibodies or antigen-binding fragments thereof, described herein, are combined or co-administered with a second antibody or antigen-binding fragment thereof (e.g., a second non-competing broadly neutralizing antibody (bNAb)) that binds to an epitope or region of the gp41 fusion peptide and competes with or comprises VH and VL regions from an antibody selected from the group consisting of VRC34 and ACS202.

Additional broadly neutralizing antibodies which can be used as a second therapeutic agent in a combination therapy are described, e.g., in U.S. Pat. Nos. 8,673,307; 9,493,549; 9,783,594; and WO 2012/154312; WO2012/158948; WO 2013/086533; WO 2013/142324; WO2014/063059; WO 2014/089152, WO 2015/048462; WO 2015/103549; WO 2015/117008; WO2016/014484; WO 2016/154003; WO 2016/196975; WO 2016/149710; WO2017/096221; WO 2017/133639; WO 2017/133640, which are hereby incorporated herein by reference in their entireties for all purposes. Additional examples include those described in Sajadi, et al., Cell. (2018) 173(7):1783-1795; Sajadi, et al., J Infect Dis. (2016) 213(1):156-64; Klein et al., Nature, 492(7427): 118-22 (2012), Horwitz et al., Proc Natl Acad Sci USA, 110(41): 16538-43 (2013), Scheid, et al., Science, 333: 1633-1637 (2011), Scheid, et al., Nature, 458:636-640 (2009), Eroshkin et al, Nucleic Acids Res., 42 (Database issue):Dl 133-9 (2014), Mascola et al., Immunol Rev., 254(1):225-44 (2013), such as 2F5, 4E10, M66.6, CAP206-CH12, 10E8, 10E8v4, 10E8-5R-100cF, DH511.11P, 7b2, and LN01 (all of which bind the MPER of gp41); PG9, PG16, CH01-04 (all of which bind V1V2-glycan), 2G12 (which binds to outer domain glycan), which are hereby incorporated herein by reference in their entireties for all purposes.

Exemplary VH and VL amino acid sequences of an anti-gp120 antibody of this disclosure that are used in the combination therapy include the sequences set forth in SEQ ID NOs: 182 and 275, respectively; SEQ ID NOs: 182 and 278, respectively; SEQ ID NOs: 182 and 279, respectively; SEQ ID NOs: 182 and 280, respectively; SEQ ID NOs: 182 and 281, respectively; SEQ ID NOs: 182 and 282, respectively; SEQ ID NOs: 182 and 292, respectively; SEQ ID NOs: 182 and 304, respectively; SEQ ID NOs: 182 and 307, respectively; SEQ ID NOs: 182 and 309, respectively; SEQ ID NOs: 182 and 310, respectively; SEQ ID NOs: 220 and 310, respectively; SEQ ID NOs: 477 and 223, respectively; SEQ ID NOs: 477 and 278, respectively; SEQ ID NOs: 477 and 292, respectively; and SEQ ID NOs: 220 and 311, respectively. In certain embodiments, the VH and VL amino acid sequences of an anti-gp120 antibody used in the combination therapy are the sequences set forth in SEQ ID NOs: 477 and 278, respectively. In certain embodiments, the arm of the bispecific antibody that binds to gp120 comprises an amino acid sequence of a heavy chain of an anti-gp120 antibody disclosed herein. In certain embodiments, the arm of the bispecific antibody that binds to gp120 comprises an amino acid sequence of a light chain of an anti-gp120 antibody disclosed herein. Exemplary heavy chain and light chain sequences of an anti-gp120 antibody of this disclosure that are used in the combination therapy include the sequences set forth in SEQ ID NOs: 2 and 49, respectively; SEQ ID NOs: 2 and 100, respectively; SEQ ID NOs: 42 and 101, respectively; SEQ ID NOs: 2 and 103, respectively; SEQ ID NOs: 2 and 104, respectively; SEQ ID NOs: 2 and 105, respectively; SEQ ID NOs: 2 and 106, respectively; SEQ ID NOs: 2 and 107, respectively; SEQ ID NOs: 2 and 117, respectively; SEQ ID NOs: 2 and 129, respectively; SEQ ID NOs: 2 and 132, respectively; SEQ ID NOs: 2 and 134, respectively; SEQ ID NOs: 2 and 569, respectively; SEQ ID NOs: 42 and 135, respectively; SEQ ID NOs: 529 and 49, respectively; SEQ ID NOs: 529 and 103, respectively; SEQ ID NOs: 529 and 117, respectively; and SEQ ID NOs: 42 and 136, respectively. In certain embodiments, the heavy chain and light chain sequences of an anti-gp120 antibody used in the combination therapy are the sequences set forth in SEQ ID NOs: 529 and 103, respectively.

In one embodiment, pharmaceutical compositions comprising an antibody disclosed herein, or a pharmaceutical composition thereof, in combination with one or more (e.g., one, two, three, one or two, or one to three) additional therapeutic agents, and a pharmaceutically acceptable carrier, diluent, or excipient are provided.

In certain embodiments, the present disclosure provides a method for treating an HIV infection, comprising administering to a patient in need thereof a therapeutically effective amount of an antibody disclosed herein, or a pharmaceutical composition thereof, in combination with a therapeutically effective amount of one or more additional therapeutic agents which are suitable for treating an HIV infection.

In certain embodiments, an antibody disclosed herein, or a pharmaceutical composition thereof, is combined with one, two, three, four, or more additional therapeutic agents. In certain embodiments, an antibody disclosed herein, or a pharmaceutical composition thereof, is combined with two additional therapeutic agents. In other embodiments, an antibody disclosed herein, or a pharmaceutical composition thereof, is combined with three additional therapeutic agents. In further embodiments, an antibody disclosed herein, or a pharmaceutical composition thereof, is combined with four additional therapeutic agents. The one, two, three, four, or more additional therapeutic agents can be different therapeutic agents selected from the same class of therapeutic agents, and/or they can be selected from different classes of therapeutic agents.

In certain embodiments, an antibody disclosed herein is administered with one or more additional therapeutic agents. Co-administration of an antibody disclosed herein with one or more additional therapeutic agents generally refers to simultaneous or sequential administration of a compound disclosed herein and one or more additional therapeutic agents, such that therapeutically effective amounts of the antibody disclosed herein and the one or more additional therapeutic agents are both present in the body of the patient. When administered sequentially, the combination may be administered in two or more administrations.

Co-administration includes administration of unit dosages of the antibodies disclosed herein before or after administration of unit dosages of one or more additional therapeutic agents. For example, the antibody disclosed herein may be administered within seconds, minutes, or hours of the administration of the one or more additional therapeutic agents. In some embodiments, a unit dose of an antibody disclosed herein is administered first, followed within seconds or minutes by administration of a unit dose of one or more additional therapeutic agents. Alternatively, a unit dose of one or more additional therapeutic agents is administered first, followed by administration of a unit dose of an antibody disclosed herein within seconds or minutes. In other embodiments, a unit dose of an antibody disclosed herein is administered first, followed, after a period of hours (e.g., 1-12 hours), by administration of a unit dose of one or more additional therapeutic agents. In yet other embodiments, a unit dose of one or more additional therapeutic agents is administered first, followed, after a period of hours (e.g., 1-12 hours), by administration of a unit dose of an antibody disclosed herein.

In certain embodiments, an antibody disclosed herein is combined with one or more additional therapeutic agents in a unitary dosage form for simultaneous administration to a patient, for example as a solid dosage form for oral administration.

In certain embodiments, an antibody of this disclosure is formulated as a liquid, which may optionally contain an additional therapeutic agent(s) useful for treating HIV. In certain embodiments, the liquid can contain another active ingredient for treating HIV, such as another anti-HIV antibody or antigen-binding fragment thereof, a HIV protease inhibitor, a HIV non-nucleoside or non-nucleotide inhibitor of reverse transcriptase, a HIV nucleoside or nucleotide inhibitor of reverse transcriptase, a HIV integrase inhibitor, a HIV non-catalytic site (or allosteric) integrase inhibitor, pharmacokinetic enhancer, and combinations thereof.

In some embodiments, the additional therapeutic agent is a latency reversing agent (LRA), e.g., an agonist of a toll-like receptor (TLR), e.g., an agonist of TLR1 (NCBI Gene ID: 7096), TLR2 (NCBI Gene ID: 7097), TLR3 (NCBI Gene ID: 7098), TLR4 (NCBI Gene ID: 7099), TLR5 (NCBI Gene ID: 7100), TLR6 (NCBI Gene ID: 10333), TLR7 (NCBI Gene ID: 51284), TLR8 (NCBI Gene ID: 51311), TLR9 (NCBI Gene ID: 54106), and/or TLR10 (NCBI Gene ID: 81793). In some embodiments, the LRA is a TLR7 agonist. In other embodiments, the additional therapeutic agent is a latency reversing agent (LRA), e.g., a TLR8 agonist. Examples of TLR agonists include but are not limited to Vesatolimod. Additional examples include but are not limited to the compounds described in U.S. Pat. No. 8,367,670 and the compounds described in U.S. Patent Application Publication No. 2016/0289229. In one embodiment, the antibody of the present invention may be combined with TLR7 agonist such as Vesatolimod. In another embodiment, the antibody of the present invention may be combined with TLR8 agonist, e.g., GS-9688. In one embodiment, the additional therapeutic agent is a TLR modulator. TLR modulators may include modulators of TLR1, TLR2, TLR3, TLR4, TLR5, TLR6, TLR7, TLR8, TLR9, TLR10, TLR11, TLR12, and TLR13. Examples of TLR3 modulators include rintatolimod, poly-ICLC, RIBOXXON®, Apoxxim, RIBOXXIM®, IPH-33, MCT-465, MCT-475, and ND-1.1. Examples of TLR7 modulators include GS-9620, GSK-2245035, imiquimod, resiquimod, DSR-6434, DSP-3025, IMO-4200, MCT-465, MEDI-9197, 3M-051, SB-9922, 3M-052, Limtop, TMX-30X, TMX-202, RG-7863, RG-7795, and the compounds disclosed in US20100143301 (Gilead Sciences), US20110098248 (Gilead Sciences), and US20090047249 (Gilead Sciences). Examples of TLR8 modulators include GS-9688, motolimod, resiquimod, 3M-051, 3M-052, MCT-465, IMO-4200, VTX-763, VTX-1463, and the compounds disclosed in US20140045849 (Janssen), US20140073642 (Janssen), WO2014/056953 (Janssen), WO2014/076221 (Janssen), WO2014/128189 (Janssen), US20140350031 (Janssen), WO2014/023813 (Janssen), US20080234251 (Array Biopharma), US20080306050 (Array Biopharma), US20100029585 (Ventirx Pharma), US20110092485 (Ventirx Pharma), US20110118235 (Ventirx Pharma), US20120082658 (Ventirx Pharma), US20120219615 (Ventirx Pharma), US20140066432 (Ventirx Pharma), US20140088085 (Ventirx Pharma), US20140275167 (Novira Therapeutics), and US20130251673 (Novira Therapeutics). Examples of TLR9 modulators include BB-001, BB-006, CYT-003, IMO-2055, IMO-2125, IMO-3100, IMO-8400, IR-103, IMO-9200, agatolimod, DIMS-9054, DV-1079, DV-1179, AZD-1419, leftolimod (MGN-1703), litenimod, and CYT-003-QbG10.

In some embodiments, the additional therapeutic agent is an agonist of DExD/H-box helicase 58 (DDX58; a.k.a., RIG-I, RIG1, RIGI, RLR-1, SGMRT2; NCBI Gene ID: 23586). An illustrative RIG-I agonist is KIN1148, described by Hemann, et al., *J Immunol* May 1, 2016, 196 (1 Supplement) 76.1. Additional RIG-I agonists are described, e.g., in Elion, et al., *Cancer Res.* (2018) 78(21):6183-6195; and Liu, et al., *J Virol.* (2016) 90(20):9406-19. RIG-I agonists are commercially available, e.g., from Invivogen (invivogen.com).

In certain embodiments, such formulations are suitable for once daily dosing.

In some embodiments, the additional therapeutic agent may be an anti-HIV agent. In some instances, the additional therapeutic agent can be HIV protease inhibitors, HIV non-nucleoside or non-nucleotide inhibitors of reverse transcriptase, HIV nucleoside or nucleotide inhibitors of reverse transcriptase, HIV integrase inhibitors, HIV non-catalytic site (or allosteric) integrase inhibitors, HIV entry inhibitors, HIV maturation inhibitors, HIV capsid inhibitors, HIV Tat or Rev inhibitors, immunomodulators (e.g., immunostimulators), immunotherapeutic agents, antibody-drug conjugates, gene modifiers, gene editors (such as CRISPR/Cas9, zinc finger nucleases, homing nucleases, synthetic nucleases, TALENs), cell therapies (such as chimeric antigen receptor T-cell, CAR-T, and engineered T-cell receptors, TCR-T, autologous T-cell therapies), latency reversing agents, compounds that target the HIV capsid, immune-based therapies, phosphatidylinositol 3-kinase (PI3K) inhibitors, HIV antibodies, bispecific antibodies and "antibody-like" therapeutic proteins, HIV p17 matrix protein inhibitors, IL-13 antagonists, peptidyl-prolyl cis-trans isomerase A modulators, protein disulfide isomerase inhibitors, complement C5a receptor antagonists, DNA methyltransferase inhibitor, HIV vif gene modulators, Vif dimerization antagonists, HIV-1 viral infectivity factor inhibitors, TAT protein inhibitors, HIV-1 Nef modulators, Hck tyrosine kinase modulators, mixed lineage kinase-3 (MLK-3) inhibitors, HIV-1 splicing inhibitors, Rev protein inhibitors, integrin antagonists, nucleoprotein inhibitors, splicing factor modulators, COMM domain containing protein 1 modulators, HIV ribonuclease H inhibitors, retrocyclin modulators, CDK-9 inhibitors, dendritic ICAM-3 grabbing nonintegrin 1 inhibitors, HIV GAG protein inhibitors, HIV POL protein inhibitors, Complement Factor H modulators, ubiquitin ligase inhibitors, deoxycytidine kinase inhibitors, cyclin dependent kinase inhibitors, proprotein convertase PC9 stimulators, ATP dependent RNA helicase DDX3X inhibitors, reverse transcriptase priming complex inhibitors, G6PD and NADH-oxidase inhibitors, pharmacokinetic enhancers, HIV gene therapy, HIV vaccines, and combinations thereof.

In some embodiments, the additional therapeutic agent is selected from the group consisting of combination drugs for HIV, other drugs for treating HIV, HIV protease inhibitors, HIV reverse transcriptase inhibitors, HIV integrase inhibitors, HIV non-catalytic site (or allosteric) integrase inhibitors, HIV entry (fusion) inhibitors, HIV maturation inhibitors, latency reversing agents, capsid inhibitors, immune-based therapies, PI3K inhibitors, HIV antibodies, and bispecific antibodies, and "antibody-like" therapeutic proteins, and combinations thereof.

Combination Drugs

In certain embodiments, the antibodies or antigen-binding fragments described herein are combined with an HIV combination drug. In certain embodiments, the antibody or antigen-binding fragment thereof comprises VH CDRs and VL CDRs having the sequences set forth in: SEQ ID NOs.: 137, 138, 139, 140, 141, and 142, respectively. In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a VH that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 477 and a VL that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 278. In certain embodiments, the antibody or antigen-binding fragment thereof comprises a VH sequence set forth in SEQ ID NO: 477 and a VL sequence set forth in SEQ ID NO: 278. In certain embodiments, the antibody or antigen-binding fragment thereof comprises VH CDRs and VL CDRs having the sequences set forth in: SEQ ID NOs.: 137, 138, 139, 140, 141, and 142, respectively, and comprises a heavy chain that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 529 and a light chain that is at least 80%, at least 85%, at least 90%, at least 91%, at least 92%, at least 93%, at least 94%, at least 95%, at least 96%, at least 97%, at least 98%, at least 99%, such as 100%, identical to an amino acid sequence set forth in SEQ ID NO: 103. In certain embodiments, the antibody or antigen-binding fragment thereof comprises a heavy chain sequence set forth in SEQ ID NO: 529 and a light chain sequence set forth in SEQ ID NO: 103. Examples of combination drugs that can be employed with an antibody of this disclosure include ATRIPLA® (efavirenz, tenofovir disoproxil fumarate, and emtricitabine); COMPLERA® (EVIPLERA®; rilpivirine, tenofovir disoproxil fumarate, and emtricitabine); STRIBILD® (elvitegravir, cobicistat, tenofovir disoproxil fumarate, and emtricitabine); TRUVADA® (tenofovir disoproxil fumarate and emtricitabine; TDF+FTC); DESCOVY® (tenofovir alafenamide and emtricitabine); ODEFSEY® (tenofovir alafenamide, emtricitabine, and rilpivirine); GENVOYA® (tenofovir alafenamide, emtricitabine, cobicistat, and elvitegravir); darunavir, tenofovir alafenamide hemifumarate, emtricitabine, and cobicistat; efavirenz, lamivudine, and tenofovir disoproxil fumarate; lamivudine and tenofovir disoproxil fumarate; tenofovir and lamivudine; tenofovir alafenamide and emtricitabine; tenofovir alafenamide hemifumarate and emtricitabine; tenofovir alafenamide hemifumarate, emtricitabine, and rilpivirine; tenofovir alafenamide hemifumarate, emtricitabine, cobicistat, and elvitegravir; COMBIVIR® (zidovudine and lamivudine; AZT+3TC); EPZICOM® (LIVEXA®; abacavir sulfate and lamivudine; ABC+3TC); KALETRA® (ALUVIA®; lopinavir and ritonavir); TRIUMEQ® (dolutegravir, abacavir, and lamivudine); TRIZIVIR® (abacavir sulfate, zidovudine, and lamivudine; ABC+AZT+3TC); atazanavir and cobicistat; atazanavir sulfate and cobicistat; atazanavir sulfate and ritonavir; darunavir and cobicistat; dolutegravir and rilpivirine; dolutegravir and rilpivirine hydrochloride; dolutegravir, abacavir sulfate, and lamivudine; lamivudine, nevirapine, and zidovudine; raltegravir and lamivudine; doravirine, lamivudine, and tenofovir disoproxil fumarate; doravirine, lamivudine, and tenofovir disoproxil; dolutegravir+lamivudine, lamivudine+abacavir+zidovudine, lamivudine+abacavir, lamivudine+tenofovir disoproxil fumarate, lamivudine+zidovudine+nevirapine, lopinavir+ritonavir, lopinavir+ritonavir+abacavir+lamivudine, lopinavir+ritonavir+zidovudine+lamivudine, tenofovir+lamivudine, and tenofovir disoproxil fumarate+emtricitabine+rilpivirine hydrochloride, lopinavir, ritonavir, zidovudine and lamivudine; Vacc-4x and romidepsin; and APH-0812.

Other HIV Drugs

Examples of other drugs for treating HIV that can be combined with an antibody of this disclosure include acemannan, alisporivir, BanLec, deferiprone, Gamimune, metenkefalin, naltrexone, Prolastin, REP 9, RPI-MN, VSSP, H1viral, SB-728-T, 1,5-dicaffeoylquinic acid, rHIV7-shl-TAR-CCR5RZ, AAV-eCD4-Ig gene therapy, MazF gene therapy, BlockAide, ABX-464, AG-1105, APH-0812, BIT-225, CYT-107, HGTV-43, HPH-116, HS-10234, IMO-3100, IND-02, MK-1376, MK-2048, MK-4250, MK-8507, MK-8591, NOV-205, PA-1050040 (PA-040), PGN-007, SCY-635, SB-9200, SCB-719, TR-452, TEV-90110, TEV-90112, TEV-90111, TEV-90113, RN-18, Immuglo, and VIR-576.

HIV Protease Inhibitors

In certain embodiments, the antibodies or antigen-binding fragments described herein are combined with an HIV protease inhibitor. Examples of HIV protease inhibitors that can be combined with an antibody of this disclosure include amprenavir, atazanavir, brecanavir, darunavir, fosamprenavir, fosamprenavir calcium, indinavir, indinavir sulfate, lopinavir, nelfinavir, nelfinavir mesylate, ritonavir, saquinavir, saquinavir mesylate, tipranavir, DG-17, TMB-657 (PPL-100), T-169, BL-008, MK-8122, TMB-607, and TMC-310911.

HIV Reverse Transcriptase Inhibitors

In certain embodiments, the antibodies or antigen-binding fragments described herein are combined with a non-nucleoside or non-nucleotide inhibitor. Examples of HIV non-nucleoside or non-nucleotide inhibitors of reverse transcriptase that can be combined with an antibody of this disclosure include dapivirine, delavirdine, delavirdine mesylate, doravirine, efavirenz, etravirine, lentinan, nevirapine, rilpivirine, ACC-007, AIC-292, KM-023, PC-1005, and elsulfavirine (VM-1500.).

In certain embodiments, the antibodies or antigen-binding fragments described herein are combined with an HIV nucleoside or nucleotide inhibitor. Examples of HIV nucleoside or nucleotide inhibitors of reverse transcriptase that can be combined with an antibody of this disclosure include adefovir, adefovir dipivoxil, azvudine, emtricitabine, tenofovir, tenofovir alafenamide, tenofovir alafenamide fumarate, tenofovir alafenamide hemifumarate, tenofovir disoproxil, tenofovir disoproxil fumarate, tenofovir disoproxil hemifumarate, VIDEX® and VIDEX EC® (didanosine, ddI), abacavir, abacavir sulfate, alovudine, apricitabine, censavudine, didanosine, elvucitabine, festinavir, fosalvudine tidoxil, CMX-157, dapivirine, doravirine, etravirine, OCR-5753, tenofovir disoproxil orotate, fozivudine tidoxil, lamivudine, phosphazid, stavudine, zalcitabine, zidovudine, rovafovir etalafenamide (GS-9131), GS-9148, MK-8504, MK-8591, MK-858, VM-2500 and KP-1461.

HIV Integrase Inhibitors

In certain embodiments, the antibodies or antigen-binding fragments described herein are combined with an HIV integrase inhibitor. Examples of HIV integrase inhibitors that can be combined with an antibody of this disclosure include elvitegravir, curcumin, derivatives of curcumin, chicoric acid, derivatives of chicoric acid, 3,5-dicaffeoylquinic acid, derivatives of 3,5-dicaffeoylquinic acid, aurintricarboxylic acid, derivatives of aurintricarboxylic acid, caffeic acid phenethyl ester, derivatives of caffeic acid phenethyl ester, tyrphostin, derivatives of tyrphostin, quercetin, derivatives of quercetin, raltegravir, dolutegravir, JTK-351, bictegravir, AVX-15567, cabotegravir (long-acting injectable), diketo quinolin-4-1 derivatives, integrase-LEDGF inhibitor, ledgins, M-522, M-532, NSC-310217, NSC-371056, NSC-48240, NSC-642710, NSC-699171, NSC-699172, NSC-699173, NSC-699174, stilbenedisulfonic acid, T-169, VM-3500 and cabotegravir.

In certain embodiments, the antibodies or antigen-binding fragments described herein are combined with a HIV non-catalytic site, or allosteric, integrase inhibitor (NCINI). Examples of HIV non-catalytic site, or allosteric, integrase inhibitors (NCINI) that can be combined with an antibody of this disclosure include CX-05045, CX-05168, and CX-14442.

HIV Entry Inhibitors

In certain embodiments, the antibodies or antigen-binding fragments described herein are combined with an HIV entry inhibitor. Examples of HIV entry (fusion) inhibitors that can be combined with an antibody of this disclosure include cenicriviroc, CCR5 inhibitors, gp41 inhibitors, CD4 attachment inhibitors, gp120 inhibitors, and CXCR4 inhibitors.

In certain embodiments, the antibodies or antigen-binding fragments described herein are combined with a CCR5 inhibitor. Examples of CCR5 inhibitors that can be combined with an antibody of this disclosure include aplaviroc, vicriviroc, maraviroc, cenicriviroc, leronlimab (PRO-140), adaptavir (RAP-101), nifeviroc (TD-0232), anti-GP120/CD4 or CCR5 bispecific antibodies, B-07, MB-66, polypeptide C25P, TD-0680, and vMIP (Haimipu).

In certain embodiments, the antibodies or antigen-binding fragments described herein are combined with a gp41 inhibitor. Examples of gp41 inhibitors that can be combined with an antibody of this disclosure include albuvirtide, enfuvirtide, BMS-986197, enfuvirtide biobetter, enfuvirtide biosimilar, HIV-1 fusion inhibitors (P26-Bapc), ITV-1, ITV-2, ITV-3, ITV-4, PIE-12 trimer and sifuvirtide.

In certain embodiments, the antibodies or antigen-binding fragments described herein are combined with a CD4 attachment inhibitor. Examples of CD4 attachment inhibitors that can be combined with an antibody of this disclosure include ibalizumab and CADA analogs.

In certain embodiments, the antibodies or antigen-binding fragments described herein are combined with a gp120 inhibitor. Examples of gp120 inhibitors that can be combined with an antibody of this disclosure include Radha-108 (receptol) 3B3-PE38, BanLec, bentonite-based nanomedicine, fostemsavir tromethamine, IQP-0831, and BMS-663068

In certain embodiments, the antibodies or antigen-binding fragments described herein are combined with a CXCR4 inhibitor. Examples of CXCR4 inhibitors that can be combined with an antibody of this disclosure include plerixafor, ALT-1188, N15 peptide, and vMIP (Haimipu).

In certain embodiments, the antibodies or antigen-binding fragments described herein are combined with a HIV maturation inhibitor. Examples of HIV maturation inhibitors that can be combined with an antibody of this disclosure include BMS-955176, GSK-3640254 and GSK-2838232.

Latency Reversing Agents

In certain embodiments, the antibodies or antigen-binding fragments described herein are combined with a latency reversing agent (LRA). Examples of latency reversing agents that can be combined with an antibody of this disclosure include toll-like receptor (TLR) agonists (including TLR7 agonists, e.g., GS-9620 and TLR8 agonists, e.g., GS-9688), histone deacetylase (HDAC) inhibitors, proteasome inhibitors such as velcade, protein kinase C (PKC) activators, Smyd2 inhibitors, BET-bromodomain 4 (BRD4) inhibitors, ionomycin, IAP antagonists (inhibitor of apoptotis proteins, such as APG-1387, LBW-242), SMAC mimetics (including TL32711, LCL161, GDC-0917, HGS1029, AT-406), PMA, SAHA (suberanilohydroxamic acid, or suberoyl, anilide, and hydroxamic acid), NIZ-985, IL-15 modulating antibodies (including IL-15, IL-15 fusion proteins and IL-15 receptor agonists, e.g., ALT-803), JQ1, disulfiram, amphotericin B, and ubiquitin inhibitors such as largazole analogs, APH-0812, and GSK-343. Examples of HDAC inhibitors include romidepsin, vorinostat, and panobinostat. Examples of PKC activators include indolactam, prostratin, ingenol B, and DAG-lactones.

Toll-Like Receptor (TLR) Agonists

In various embodiments, the antibodies or antigen-binding fragments as described herein, are combined with an agonist of a toll-like receptor (TLR), e.g., an agonist of TLR1 (NCBI Gene ID: 7096), TLR2 (NCBI Gene ID: 7097), TLR3 (NCBI Gene ID: 7098), TLR4 (NCBI Gene ID: 7099), TLR5 (NCBI Gene ID: 7100), TLR6 (NCBI Gene ID: 10333), TLR7 (NCBI Gene ID: 51284), TLR8 (NCBI Gene ID: 51311), TLR9 (NCBI Gene ID: 54106), and/or TLR10 (NCBI Gene ID: 81793). Example TLR7 agonists that can be co-administered include without limitation AL-034, DSP-0509, GS-9620 (vesatolimod), LHC-165, TMX-101 (imiquimod), GSK-2245035, resiquimod, DSR-6434, DSP-3025, IMO-4200, MCT-465, MEDI-9197, 3M-051, SB-9922, 3M-052, Limtop, TMX-30X, TMX-202, RG-7863, RG-7854, RG-7795, and the compounds disclosed in US20100143301 (Gilead Sciences), US20110098248 (Gilead Sciences), and US20090047249 (Gilead Sciences), US20140045849 (Janssen), US20140073642 (Janssen), WO2014/056953 (Janssen), WO2014/076221 (Janssen), WO2014/128189 (Janssen), US20140350031 (Janssen), WO2014/023813 (Janssen), US20080234251 (Array Biopharma), US20080306050 (Array Biopharma), US20100029585 (Ventirx Pharma), US20110092485 (Ventirx Pharma), US20110118235 (Ventirx Pharma), US20120082658 (Ventirx Pharma), US20120219615 (Ventirx Pharma), US20140066432 (Ventirx Pharma), US20140088085 (Ventirx Pharma), US20140275167 (Novira Therapeutics), and US20130251673 (Novira Therapeutics). An TLR7/TLR8 agonist that can be co-administered is NKTR-262, telratolimod and BDB-001. Example TLR8 agonists that can be co-administered include without limitation E-6887, IMO-4200, IMO-8400, IMO-9200, MCT-465, MEDI-9197, motolimod, resiquimod, GS-9688, VTX-1463, VTX-763, 3M-051, 3M-052, and the compounds disclosed in US20140045849 (Janssen), US20140073642 (Janssen), WO2014/056953 (Janssen), WO2014/076221 (Janssen), WO2014/128189 (Janssen), US20140350031 (Janssen), WO2014/023813 (Janssen), US20080234251 (Array Biopharma), US20080306050 (Array Biopharma), US20100029585 (Ventirx Pharma), US20110092485 (Ventirx Pharma), US20110118235 (Ventirx Pharma), US20120082658 (Ventirx Pharma), US20120219615 (Ventirx Pharma), US20140066432 (Ventirx Pharma), US20140088085 (Ventirx Pharma), US20140275167 (Novira Therapeutics), and US20130251673 (Novira Therapeutics). Example TLR9 agonists that can be co-administered include without limitation AST-008, cobitolimod, CMP-001, IMO-2055, IMO-2125, litenimod, MGN-1601, BB-001, BB-006, IMO-3100, IMO-8400, IR-103, IMO-9200, agatolimod, DIMS-9054, DV-1079, DV-1179, AZD-1419, lefitolimod (MGN-1703), CYT-003, CYT-003-QbG10, tilsotolimod and PUL-042. Examples of TLR3 agonist include rintatolimod, poly-ICLC, RIBOXXON®, Apoxxim, RIBOXXIM®, IPH-33, MCT-465, MCT-475, and ND-1.1. Examples of TLR4 agonist include G-100, and GSK-1795091.

Histone Deacetylase (HDAC) Inhibitors

In various embodiments, the antibodies or antigen-binding fragments as described herein, are combined with an inhibitor of a histone deacetylase, e.g., histone deacetylase 9 (HDAC9, HD7, HD7b, HD9, HDAC, HDAC7, HDAC7B, HDAC9B, HDAC9FL, HDRP, MITR; Gene ID: 9734). Examples of HDAC inhibitors include without limitation, abexinostat, ACY-241, AR-42, BEBT-908, belinostat, CKD-581, CS-055 (HBI-8000), CUDC-907 (fimepinostat), entinostat, givinostat, mocetinostat, panobinostat, pracinostat, quisinostat (JNJ-26481585), resminostat, ricolinostat, romidepsin, SHP-141, valproic acid (VAL-001), vorinostat, tinostamustine, remetinostat, entinostat.

Capsid Inhibitors

In certain embodiments, the antibodies or antigen-binding fragments described herein are combined with a capsid inhibitor. Examples of capsid inhibitors that can be combined with an antibody of this disclosure include capsid polymerization inhibitors or capsid disrupting compounds, HIV nucleocapsid p7 (NCp7) inhibitors such as azodicarbonamide, HIV p24 capsid protein inhibitors, GS-6207, AVI-621, AVI-101, AVI-201, AVI-301, and AVI-CAN1-15 series.

Immune-Based Therapies

In certain embodiments, the antibodies or antigen-binding fragments described herein are combined with an immune-based therapy. Examples of immune-based therapies that can be combined with an antibody of this disclosure include toll-like receptors (TLR) modulators (e.g., agonists) such as TLR1, TLR 2, TLR 3, TLR 4, TLR 5, TLR 6, TLR 7, TLR 8, TLR 9, TLR 10, TLR 11, TLR 12, and/or TLR 13 agonists; programmed cell death protein 1 (PD-1) modulators; programmed death-ligand 1 (PD-L1) modulators; IL-15 agonists (e.g., ALT-803); DermaVir; interleukin-7; plaquenil (hydroxychloroquine); proleukin (aldesleukin, IL-2); interferon alfa; interferon alfa-2b; interferon alfa-n3; pegylated interferon alfa; interferon gamma; hydroxyurea; mycophenolate mofetil (MPA) and its ester derivative mycophenolate mofetil (MMF); ribavirin; rintatolimod, polymer polyethyleneimine (PEI); gepon; IL-12; WF-10; VGV-1; MOR-22; BMS-936559; CYT-107, interleukin-15/Fc fusion protein, AM-0015, ALT-803, NIZ-985, NKTR-255, normferon, peginterferon alfa-2a, peginterferon alfa-2b, recombinant interleukin-15, RPI-MN, GS-9620, GS-9688, STING modulators, RIG-I modulators, NOD2 modulators, SB-9200, and IR-103.

In certain embodiments, the antibodies or antigen-binding fragments described herein are combined with a TLR agonist. Examples of TLR agonists include without limitation: vesatolimod (GS-9620), lefitolimod, tilsotolimod, rintatolimod, DSP-0509, AL-034, G-100, cobitolimod, AST-008, motolimod, GSK-1795091, GSK-2245035, VTX-1463, GS-9688, LHC-165, BDB-001, RG-7854, and telratolimod.

Immune Checkpoint Receptor Protein Modulators

In various embodiments, the antibodies or antigen-binding fragments as described herein, are combined with one or more blockers or inhibitors of inhibitory immune checkpoint proteins or receptors and/or with one or more stimulators, activators or agonists of one or more stimulatory immune checkpoint proteins or receptors. Blockade or inhibition of inhibitory immune checkpoints can positively regulate T-cell or NK cell activation and prevent immune escape of infected cells. Activation or stimulation of stimulatory immune check points can augment the effect of immune checkpoint inhibitors in infective therapeutics. In various embodiments, the immune checkpoint proteins or receptors regulate T cell responses (e.g., reviewed in Xu, et al., J Exp Clin Cancer Res. (2018) 37:110). In various embodiments, the immune checkpoint proteins or receptors regulate NK cell responses (e.g., reviewed in Davis, et al., Semin Immunol. (2017) 31:64-75 and Chiossone, et al., Nat Rev Immunol. (2018) 18(11):671-688).

Examples of immune checkpoint proteins or receptors include without limitation CD27, CD70; CD40, CD40LG; CD47, CD48 (SLAMF2), transmembrane and immunoglobulin domain containing 2 (TMIGD2, CD28H), CD84 (LY9B, SLAMF5), CD96, CD160, MS4A1 (CD20), CD244 (SLAMF4); CD276 (B7H3); V-set domain containing T cell activation inhibitor 1 (VTCN1, B7H4); V-set immunoregulatory receptor (VSIR, B7H5, VISTA); immunoglobulin superfamily member 11 (IGSF11, VSIG3); natural killer cell cytotoxicity receptor 3 ligand 1 (NCR3LG1, B7H6); HERV-H LTR-associating 2 (HHLA2, B7H7); inducible T cell co-stimulator (ICOS, CD278); inducible T cell costimulator ligand (ICOSLG, B7H2); TNF receptor superfamily member 4 (TNFRSF4, OX40); TNF superfamily member 4 (TNFSF4, OX40L); TNFRSF8 (CD30), TNFSF8 (CD30L); TNFRSF10A (CD261, DR4, TRAILR1), TNFRSF9 (CD137), TNFSF9 (CD137L); TNFRSF10B (CD262, DR5, TRAILR2), TNFRSF10 (TRAIL); TNFRSF14 (HVEM, CD270), TNFSF14 (HVEML); CD272 (B and T lymphocyte associated (BTLA)); TNFRSF17 (BCMA, CD269), TNFSF13B (BAFF); TNFRSF18 (GITR), TNFSF18 (GITRL); MHC class I polypeptide-related sequence A (MICA); MHC class I polypeptide-related sequence B (MICB); CD274 (CD274, PDL1, PD-L1); programmed cell death 1 (PDCD1, PD1, PD-1); cytotoxic T-lymphocyte associated protein 4 (CTLA4, CD152); CD80 (B7-1), CD28; nectin cell adhesion molecule 2 (NECTIN2, CD112); CD226 (DNAM-1); Poliovirus receptor (PVR) cell adhesion molecule (PVR, CD155); PVR related immunoglobulin domain containing (PVRIG, CD112R); T cell immunoreceptor with Ig and ITIM domains (TIGIT); T cell immunoglobulin and mucin domain containing 4 (TIMD4; TIM4); hepatitis A virus cellular receptor 2 (HAVCR2, TIMD3, TIM3); galectin 9 (LGALS9); lymphocyte activating 3 (LAG3, CD223); signaling lymphocytic activation molecule family member 1 (SLAMF1, SLAM, CD150); lymphocyte antigen 9 (LY9, CD229, SLAMF3); SLAM family member 6 (SLAMF6, CD352); SLAM family member 7 (SLAMF7, CD319); UL16 binding protein 1 (ULBP1); UL16 binding protein 2 (ULBP2); UL16 binding protein 3 (ULBP3); retinoic acid early transcript 1E (RAET1E; ULBP4); retinoic acid early transcript 1G (RAET1G; ULBP5); retinoic acid early transcript 1L (RAET1L; ULBP6); lymphocyte activating 3 (CD223); killer cell immunoglobulin like receptor, three Ig domains and long cytoplasmic tail 1 (KIR, CD158E1); killer cell lectin like receptor C1 (KLRC1, NKG2A, CD159A); killer cell lectin like receptor K1 (KLRK1, NKG2D, CD314); killer cell lectin like receptor C2 (KLRC2, CD159c, NKG2C); killer cell lectin like receptor C3 (KLRC3, NKG2E); killer cell lectin like receptor C4 (KLRC4, NKG2F); killer cell immunoglobulin like receptor, two Ig domains and long cytoplasmic tail 1 (KIR2DL1); killer cell immunoglobulin like receptor, two Ig domains and long cytoplasmic tail 2 (KIR2DL2); killer cell immunoglobulin like receptor, two Ig domains and long cytoplasmic tail 3 (KIR2DL3); killer cell immunoglobulin like receptor, three Ig domains and long cytoplasmic tail 1 (KIR3DL1); killer cell lectin like receptor D1 (KLRD1); and SLAM family member 7 (SLAMF7).

In various embodiments, the antibodies or antigen-binding fragments as described herein, are combined with one or more blockers or inhibitors of one or more T-cell inhibitory immune checkpoint proteins or receptors. Illustrative T-cell inhibitory immune checkpoint proteins or receptors include without limitation CD274 (CD274, PDL1, PD-L1); programmed cell death 1 ligand 2 (PDCD1LG2, PD-L2, CD273); programmed cell death 1 (PDCD1, PD1, PD-1); cytotoxic T-lymphocyte associated protein 4 (CTLA4, CD152); CD276 (B7H3); V-set domain containing T cell activation inhibitor 1 (VTCN1, B7H4); V-set immunoregulatory receptor (VSIR, B7H5, VISTA); immunoglobulin superfamily member 11 (IGSF11, VSIG3); TNFRSF14 (HVEM, CD270), TNFSF14 (HVEML); CD272 (B and T lymphocyte associated (BTLA)); PVR related immunoglobulin domain containing (PVRIG, CD112R); T cell immunoreceptor with Ig and ITIM domains (TIGIT); lymphocyte activating 3 (LAG3, CD223); hepatitis A virus cellular receptor 2 (HAVCR2, TIMD3, TIM3); galectin 9 (LGALS9); killer cell immunoglobulin like receptor, three Ig domains and long cytoplasmic tail 1 (KIR, CD158E1); killer cell immunoglobulin like receptor, two Ig domains and long cytoplasmic tail 1 (KIR2DL1); killer cell immunoglobulin like receptor, two Ig domains and long cytoplasmic tail 2 (KIR2DL2); killer cell immunoglobulin like receptor, two Ig domains and long cytoplasmic tail 3 (KIR2DL3); and killer cell immunoglobulin like receptor, three Ig domains and long cytoplasmic tail 1 (KIR3DL1). In various embodiments, the FLT3L-Fc fusion proteins, homodimers, heterodimers, polynucleotides, vectors, LNPs and/or pharmaceutical compositions, as described herein, are combined with one or more agonist or activators of one or more T-cell stimulatory immune checkpoint proteins or receptors. Illustrative T-cell stimulatory immune checkpoint proteins or receptors include without limitation CD27, CD70; CD40, CD40LG; inducible T cell costimulator (ICOS, CD278); inducible T cell costimulator ligand (ICOSLG, B7H2); TNF receptor superfamily member 4 (TNFRSF4, OX40); TNF superfamily member 4 (TNFSF4, OX40L); TNFRSF9 (CD137), TNFSF9 (CD137L); TNFRSF18 (GITR), TNFSF18 (GITRL); CD80 (B7-1), CD28; nectin cell adhesion molecule 2 (NECTIN2, CD112); CD226 (DNAM-1); CD244 (2B4, SLAMF4), Poliovirus receptor (PVR) cell adhesion molecule (PVR, CD155). See, e.g., Xu, et al., J Exp Clin Cancer Res. (2018) 37:110.

In various embodiments, the antibodies or antigen-binding fragments as described herein, are combined with one or more blockers or inhibitors of one or more NK-cell inhibitory immune checkpoint proteins or receptors. Illustrative NK-cell inhibitory immune checkpoint proteins or receptors include without limitation killer cell immunoglobulin like receptor, three Ig domains and long cytoplasmic tail 1 (KIR, CD158E1); killer cell immunoglobulin like receptor, two Ig domains and long cytoplasmic tail 1 (KIR2DL1); killer cell immunoglobulin like receptor, two Ig domains and long cytoplasmic tail 2 (KIR2DL2); killer cell immunoglobulin like receptor, two Ig domains and long cytoplasmic tail 3 (KIR2DL3); killer cell immunoglobulin like receptor, three Ig domains and long cytoplasmic tail 1 (KIR3DL1); killer cell lectin like receptor C1 (KLRC1, NKG2A, CD159A); and killer cell lectin like receptor D1 (KLRD1, CD94). In various embodiments, the FLT3L-Fc fusion proteins, homodimers, heterodimers, polynucleotides, vectors, LNPs and/or pharmaceutical compositions, as described herein, are combined with one or more agonist or activators of one or more NK-cell stimulatory immune checkpoint proteins or receptors. Illustrative NK-cell stimulatory immune checkpoint proteins or receptors include without limitation CD16, CD226 (DNAM-1); CD244 (2B4, SLAMF4); killer cell lectin like receptor K1 (KLRK1, NKG2D, CD314); SLAM family member 7 (SLAMF7). See, e.g., Davis, et al., Semin Immunol. (2017) 31:64-75; Fang, et al., Semin Immunol. (2017) 31:37-54; and Chiossone, et al., Nat Rev Immunol. (2018) 18(11):671-688.

In some embodiments, the one or more immune checkpoint inhibitors comprises a proteinaceous (e.g., antibody or fragment thereof, or antibody mimetic) inhibitor of PD-L1 (CD274), PD-1 (PDCD1) or CTLA4. In some embodiments, the one or more immune checkpoint inhibitors comprises a small organic molecule inhibitor of PD-L1 (CD274), PD-1 (PDCD1) or CTLA4.

Examples of inhibitors of CTLA4 that can be co-administered include without limitation ipilimumab, tremelimumab, BMS-986218, AGEN1181, AGEN1884, BMS-986249, MK-1308, REGN-4659, ADU-1604, CS-1002, BCD-145, APL-509, JS-007, BA-3071, ONC-392, AGEN-2041, JHL-1155, KN-044, CG-0161, ATOR-1144, PBI-5D3H5, BPI-002, as well as multi-specific inhibitors FPT-155 (CTLA4/PD-L1/CD28), PF-06936308 (PD-1/CTLA4), MGD-019 (PD-1/CTLA4), KN-046 (PD-1/CTLA4), MEDI-5752 (CTLA4/PD-1), XmAb-20717 (PD-1/CTLA4), and AK-104 (CTLA4/PD-1).

Examples of inhibitors of PD-L1 (CD274) or PD-1 (PDCD1) that can be co-administered include without limitation pembrolizumab, nivolumab, cemiplimab, pidilizumab, AMP-224, MEDI0680 (AMP-514), spartalizumab, atezolizumab, avelumab, durvalumab, BMS-936559, CK-301, PF-06801591, BGB-A317 (tislelizumab), GLS-010 (WBP-3055), AK-103 (HX-008), AK-105, CS-1003, HLX-10, MGA-012, BI-754091, AGEN-2034, JS-001 (toripalimab), JNJ-63723283, genolimzumab (CBT-501), LZM-009, BCD-100, LY-3300054, SHR-1201, SHR-1210 (camrelizumab), Sym-021, ABBV-181, PD1-PIK, BAT-1306, (MSB0010718C), CX-072, CBT-502, TSR-042 (dostarlimab), MSB-2311, JTX-4014, BGB-A333, SHR-1316, CS-1001 (WBP-3155, KN-035, IBI-308 (sintilimab), HLX-20, KL-A167, STI-A1014, STI-A1015 (IMC-001), BCD-135, FAZ-053, TQB-2450, MDX1105-01, GS-4224, GS-4416, INCB086550, MAX10181, as well as multi-specific inhibitors FPT-155 (CTLA4/PD-L1/CD28), PF-06936308 (PD-1/CTLA4), MGD-013 (PD-1/LAG-3), FS-118 (LAG-3/PD-L1) MGD-019 (PD-1/CTLA4), KN-046 (PD-1/CTLA4), MEDI-5752 (CTLA4/PD-1), RO-7121661 (PD-1/TIM-3), XmAb-20717 (PD-1/CTLA4), AK-104 (CTLA4/PD-1), M7824 (PD-L1/TGFβ-EC domain), CA-170 (PD-L1/VISTA), CDX-527 (CD27/PD-L1), LY-3415244 (TIM3/PDL1), and INBRX-105 (4-1BB/PDL1).

In some embodiments, the small molecule inhibitor of CD274 or PDCD1 is selected from the group consisting of GS-4224, GS-4416, INCB086550 and MAX10181. In some embodiments, the small molecule inhibitor of CTLA4 comprises BPI-002.

In various embodiments, the antibodies or antigen-binding fragments as described herein are combined with anti-TIGIT antibodies, such as BMS-986207, RG-6058, AGEN-1307

TNF Receptor Superfamily (TNFRSF) Member Agonists or Activators

In various embodiments, the antibodies or antigen-binding fragments as described herein are combined with an agonist of one or more TNF receptor superfamily (TNFRSF) members, e.g., an agonist of one or more of TNFRSF1A (NCBI Gene ID: 7132), TNFRSF1B (NCBI Gene ID: 7133), TNFRSF4 (OX40, CD134; NCBI Gene ID: 7293), TNFRSF5 (CD40; NCBI Gene ID: 958), TNFRSF6 (FAS, NCBI Gene ID: 355), TNFRSF7 (CD27, NCBI Gene ID: 939), TNFRSF8 (CD30, NCBI Gene ID: 943), TNFRSF9 (4-1BB, CD137, NCBI Gene ID: 3604), TNFRSF10A (CD261, DR4, TRAILR1, NCBI Gene ID: 8797), TNFRSF10B (CD262, DR5, TRAILR2, NCBI Gene ID: 8795), TNFRSF10C (CD263, TRAILR3, NCBI Gene ID: 8794), TNFRSF10D (CD264, TRAILR4, NCBI Gene ID: 8793), TNFRSF11A (CD265, RANK, NCBI Gene ID: 8792), TNFRSF11B (NCBI Gene ID: 4982), TNFRSF12A (CD266, NCBI Gene ID: 51330), TNFRSF13B (CD267, NCBI Gene ID: 23495), TNFRSF13C (CD268, NCBI Gene ID: 115650), TNFRSF16 (NGFR, CD271, NCBI Gene ID: 4804), TNFRSF17 (BCMA, CD269, NCBI Gene ID: 608), TNFRSF18 (GITR, CD357, NCBI Gene ID: 8784), TNFRSF19 (NCBI Gene ID: 55504), TNFRSF21 (CD358, DR6, NCBI Gene ID: 27242), and TNFRSF25 (DR3, NCBI Gene ID: 8718).

Example anti-TNFRSF4 (OX40) antibodies that can be co-administered include without limitation, MEDI6469, MEDI6383, MEDI0562 (tavolixizumab), MOXR0916, PF-04518600, RG-7888, GSK-3174998, INCAGN1949, BMS-986178, GBR-8383, ABBV-368, and those described in WO2016179517, WO2017096179, WO2017096182, WO2017096281, and WO2018089628.

Example anti-TNFRSFS (CD40) antibodies that can be co-administered include without limitation RG7876, SEA-CD40, APX-005M and ABBV-428.

In some embodiments, the anti-TNFRSF7 (CD27) antibody varlilumab (CDX-1127) is co-administered.

Example anti-TNFRSF9 (4-1BB, CD137) antibodies that can be co-administered include without limitation urelumab, utomilumab (PF-05082566), AGEN2373 and ADG-106.

Example anti-TNFRSF18 (GITR) antibodies that can be co-administered include without limitation, MEDI1873, FPA-154, INCAGN-1876, TRX-518, BMS-986156, MK-1248, GWN-323, and those described in WO2017096179, WO2017096276, WO2017096189, and WO2018089628. In some embodiments, an antibody, or fragment thereof, co-targeting TNFRSF4 (OX40) and TNFRSF18 (GITR) is co-administered. Such antibodies are described, e.g., in WO2017096179 and WO2018089628.

Bi- and Tri-Specific Natural Killer (NK)-Cell Engagers

In various embodiments, the antibodies or antigen-binding fragments as described herein, are combined with a bi-specific NK-cell engager (BiKE) or a tri-specific NK-cell engager (TriKE) (e.g., not having an Fc) or bi-specific antibody (e.g., having an Fc) against an NK cell activating receptor, e.g., CD16A, C-type lectin receptors (CD94/NKG2C, NKG2D, NKG2E/H and NKG2F), natural cytotoxicity receptors (NKp30, NKp44 and NKp46), killer cell C-type lectin-like receptor (NKp65, NKp80), Fc receptor FcγR (which mediates antibody-dependent cell cytotoxicity), SLAM family receptors (e.g., 2B4, SLAM6 and SLAM7), killer cell immunoglobulin-like receptors (KIR) (KIR-2DS and KIR-3DS), DNAM-1 and CD137 (41BB). Illustrative anti-CD16 bi-specific antibodies, BiKEs or TriKEs that can be co-administered include AFM26 (BCMA/CD16A) and AFM-13 (CD16/CD30). As appropriate, the anti-CD16 binding bi-specific molecules may or may not have an Fc. BiKEs and TriKEs are described, e.g., in Felices, et al., Methods Mol Biol. (2016) 1441:333-346; Fang, et al., Semin Immunol. (2017) 31:37-54. Examples of a trispecific NK cell engager (TRiKE) include OXS-3550, and CD16-IL-15-B7H3 TriKe.

Phosphatidylinositol 3-kinase (PI3K) Inhibitors

In certain embodiments, the antibodies or antigen-binding fragments described herein are combined with a PI3K inhibitor. Examples of PI3K inhibitors that can be combined with an antibody of this disclosure include idelalisib, alpelisib, buparlisib, CAI orotate, copanlisib, duvelisib, gedatolisib, neratinib, panulisib, perifosine, pictilisib, pilaralisib, puquitinib mesylate, rigosertib, rigosertib sodium, sonolisib, taselisib, AMG-319, AZD-8186, BAY-1082439, CLR-1401, CLR-457, CUDC-907, DS-7423, EN-3342, GSK-2126458, GSK-2269577, GSK-2636771, INCB-040093, LY-3023414, MLN-1117, PQR-309, RG-7666, RP-6530, RV-1729, SAR-245409, SAR-260301, SF-1126, TGR-1202, UCB-5857, VS-5584, XL-765, and ZSTK-474.

Alpha-4/Beta-7 Antagonists

In certain embodiments, the antibodies or antigen-binding fragments described herein are combined with an alpha-4/beta-7 antagonist. Examples of Integrin alpha-4/beta-7 antagonists that can be combined with an antibody of this disclosure include PTG-100, TRK-170, abrilumab, etrolizumab, carotegrast methyl, and vedolizumab.

Examples of HIV antibodies, bispecific antibodies, and "antibody-like" therapeutic proteins that can be combined with an antibody of this disclosure include DARTs®, DUO-BODIES®, BITES®, XmAbs®, TandAbs®, Fab derivatives, bNAbs (broadly neutralizing HIV-1 antibodies), BMS-936559, TMB-360, and those targeting HIV gp120 or gp41, antibody-Recruiting Molecules targeting HIV, anti-CD63 monoclonal antibodies, anti-GB virus C antibodies, anti-GP120/CD4, CCR5 bispecific antibodies, anti-nef single domain antibodies, anti-Rev antibody, camelid derived anti-CD18 antibodies, camelid-derived anti-ICAM-1 antibodies, DCVax-001, gp140 targeted antibodies, gp41-based HIV therapeutic antibodies, human recombinant mAbs (PGT-121), ibalizumab, Immuglo, MB-66. Examples of those targeting HIV in such a manner include bavituximab, UB-421, C2F5, 2G12, C4E10, C2F5+C2G12+C4E10, 8ANC195, 3-BNC-117, 3BNC117-LS, 3BNC60, D1D2, 10-1074, 10-1074-LS, GS-9722, DH411-2, BG18, PGT145, PGT121, PGT122, PGT-151, PGT-133, PGT-134, PGT-135, PGT-128, MDX010 (ipilimumab), DH511, DH511-2, N6, N6LS, N49P6, N49P7, N49P7.1, N49P9, N49P11, N60P1.1, N60P25.1, N60P2.1, N60P31.1, N60P22, NIH 45-46, PG9, PG16, 2Dm2m, 4Dm2m, 6Dm2m, PGDM1400, MDX010

(ipilimumab), VRC01, VRC-01-LS, A32, 7B2, 10E8, VRC-07-523, VRC07-523LS, 10E8VLS, 3810109, 10E8v4, IMC-HIV, iMabm36, eCD4-Ig, IOMA, CAP256-VRC26.25, DRVIA7, VRC-HIVMAB080-00-AB, VRC-HIVMAB060-00-AB, P2G12, VRC07 and SF12. Examples of HIV bispecific and trispecific antibodies include MGD014, TMB-bispecific, SAR-441236, VRC-01/PGDM-1400/10E8v4, 10E8.4/iMab, 10E8v4/PGT121-VRC01. Example of in vivo delivered bnABs such as AAV8-VRC07; mRNA encoding anti-HIV antibody VRC01; and engineered B-cells encoding 3BNC117 (Hartweger et al, *J Exp. Med.* (2019), 1301).

Pharmacokinetic Enhancers

In certain embodiments, the antibodies or antigen-binding fragments described herein are combined with a pharmacokinetic enhancer. Examples of pharmacokinetic enhancers that can be combined with an antibody of this disclosure include cobicistat and ritonavir.

Additional Therapeutic Agents

Examples of additional therapeutic agents that can be combined with an antibody of this disclosure include the compounds disclosed in WO 2004/096286 (Gilead Sciences), WO 2006/015261 (Gilead Sciences), WO 2006/110157 (Gilead Sciences), WO 2012/003497 (Gilead Sciences), WO 2012/003498 (Gilead Sciences), WO 2012/145728 (Gilead Sciences), WO 2013/006738 (Gilead Sciences), WO 2013/159064 (Gilead Sciences), WO 2014/100323 (Gilead Sciences), US 2013/0165489 (University of Pennsylvania), US 2014/0221378 (Japan Tobacco), US 2014/0221380 (Japan Tobacco), WO 2009/062285 (Boehringer Ingelheim), WO 2010/130034 (Boehringer Ingelheim), WO 2013/006792 (Pharma Resources), US 20140221356 (Gilead Sciences), US 20100143301 (Gilead Sciences) and WO 2013/091096 (Boehringer Ingelheim).

HIV Vaccines

In certain embodiments, the antibodies or antigen-binding fragments described herein are combined with an HIV vaccine. In various embodiments, the HIV vaccine elicits a T-cell response. Illustrative vaccines that can be combined with the herein described antibodies and fragments thereof include without limitation viral vectored vaccines (e.g., arenaviruses, adenoviruses, poxviruses, rhabdovirus) as well as nucleic acid-based vaccines (e.g., DNA, RNA and self-replicating RNA). In some embodiments, the anti-HIV vaccine comprises one or more polypeptide vaccine immunogens. Examples of HIV vaccines that can be combined with an antibody of this disclosure include peptide vaccines, recombinant subunit protein vaccines, live vector vaccines, DNA vaccines, CD4-derived peptide vaccines, vaccine combinations, adenoviral vector vaccines, Chimp adenoviral vaccines (e.g., ChAdOX1, ChAd68, ChAd3 etc), Coxsackieviruses based vaccines, Gorilla adenovirus vaccines, arenavirus vaccines (LCMV, Pichinde), measles virus based vaccine, Varicella-zoster virus based vaccine, Human parainfluenza virus 3 (PIV3) based vaccines, poxvirus based vaccine (modified vaccinia virus Ankara (MVA), the NYVAC, and the ALVAC strains); rhabdovirus-based vaccines, such as VSV and marabavirus; alphavirus-based vaccines, such as semliki forest virus, venezuelan equine encephalitis virus and sindbis virus; (see Lauer, *Clinical and Vaccine Immunology*, (2017), DOI: 10.1128/CVI.00298-16); LNP formulated mRNA based therapeutic vaccines; LNP-formulated self-replicating RNA/self-amplifying RNA vaccines, rgp120 (AIDSVAX), ALVAC HIV (vCP1521)/AIDSVAX B/E (gp120) (RV144), monomeric gp120 HIV-1 subtype C vaccine, Remune, ITV-1, Contre Vir, Ad5-ENVA-48, DCVax-001 (CDX-2401), Vacc-4x, Vacc-05, VAC-3S, multiclade DNA recombinant adenovirus-5 (rAd5), rAd5 gag-pol env A/B/C vaccine, Pennvax-G, Pennvax-GP, Pennvax-G/MVA-CMDR, HIV-TriMix-mRNA vaccine, HIV-LAMP-vax, Ad35, Ad35-GRIN, NAcGM3/VSSP ISA-51, poly-ICLC adjuvanted vaccines, TatImmune, GTU-multi-HIV (FIT-06), gp140[delta]V2.TV1+MF-59, rVSVIN HIV-1 gag vaccine, SeV-Gag vaccine, AT-20, DNK-4, ad35-Grin/ENV, TBC-M4, HIVAX, HIVAX-2, NYVAC-HIV-PT1, NYVAC-HIV-PT4, DNA-HIV-PT123, rAAV1-PG9DP, GOVX-B11, GOVX-B21, TVI-HIV-1, Ad-4 (Ad4-env Clade C+Ad4-mGag), Paxvax, EN41-UGR7C, EN41-FPA2, PreVaxTat, AE-H, MYM-V101, CombiHIVvac, ADVAX, MYM-V201, MVA-CMDR, DNA-Ad5 gag/pol/nef/nev (HVTN505), MVATG-17401, ETV-01, CDX-1401, rcAD26.MOS1.HIV-Env, Ad26.Mod.HIV vaccine, Ad26.Mod.HIV+MVA mosaic vaccine+gp140, AGS-004, AVX-101, AVX-201, PEP-6409, SAV-001, ThV-01, TL-01, TUTI-16, VGX-3300, HIV-001, and virus-like particle vaccines such as pseudovirion vaccine, CombiVICHvac, LFn-p24 B/C fusion vaccine, GTU-based DNA vaccine, HIV gag/pol/nef/env DNA vaccine, anti-TAT HIV vaccine, conjugate polypeptides vaccine, dendritic-cell vaccines (e.g., such as DermaVir), gag-based DNA vaccine, GI-2010, gp41 HIV-1 vaccine, HIV vaccine (PIKA adjuvant), I i-key/MHC class II epitope hybrid peptide vaccines, ITV-2, ITV-3, ITV-4, LIPO-5, multiclade Env vaccine, MVA vaccine, Pennvax-GP, pp71-deficient HCMV vector HIV gag vaccine, recombinant peptide vaccine (HIV infection), NCI, rgp160 HIV vaccine, RNActive HIV vaccine, SCB-703, Tat Oyi vaccine, TBC-M4, therapeutic HIV vaccine, UBI HIV gp120, Vacc-4x+romidepsin, variant gp120 polypeptide vaccine, rAd5 gag-pol env A/B/C vaccine, DNA.HTI and MVA.HTI, VRC-HIVDNA016-00-VP+VRC-HIVADV014-00-VP, INO-6145, JNJ-9220, gp145 C.6980; eOD-GT8 60 mer based vaccine, PD-201401, env (A, B, C, A/E)/gag (C) DNA Vaccine, gp120 (A,B,C,A/E) protein vaccine, PDPHV-201401, Ad4-EnvCN54, EnvSeq-1 Envs HIV-1 vaccine (GLA-SE adjuvanted), HIV p24gag pri, me-boost plasmid DNA vaccine, arenavirus vector-based vaccines (Vaxwave, TheraT), MVA-BN HIV-1 vaccine regimen, UBI HIV gp120, mRNA based prophylactic vaccines, and TBL-1203HI.

Birth Control (Contraceptive) Combination Therapy

In certain embodiments, the antibodies or antigen-binding fragments described herein are combined with a birth control or contraceptive regimen. Therapeutic agents used for birth control (contraceptive) that can be combined with an antibody of this disclosure include cyproterone acetate, desogestrel, dienogest, drospirenone, estradiol valerate, ethinyl Estradiol, ethynodiol, etonogestrel, levomefolate, levonorgestrel, lynestrenol, medroxyprogesterone acetate, mestranol, mifepristone, misoprostol, nomegestrol acetate, norelgestromin, norethindrone, noretynodrel, norgestimate, ormeloxifene, segestersone acetate, ulipristal acetate, and any combinations thereof.

In one embodiment, an antibody disclosed herein, or a pharmaceutically acceptable salt thereof, is combined with one, two, three, four or more additional therapeutic agents selected from ATRIPLA® (efavirenz, tenofovir disoproxil fumarate, and emtricitabine); COMPLERA® (EVIPLERA®; rilpivirine, tenofovir disoproxil fumarate, and emtricitabine); STRIBILD® (elvitegravir, cobicistat, tenofovir disoproxil fumarate, and emtricitabine); TRUVADA® (tenofovir disoproxil fumarate and emtricitabine; TDF+FTC); DESCOVY® (tenofovir alafenamide and emtricitabine); ODEFSEY® (tenofovir alafenamide, emtricitabine, and rilpivirine); GENVOYA® (tenofovir alafenamide, emtricitabine, cobicistat, and elvitegravir); adefovir; adefovir dipivoxil; cobicistat; emtricitabine; tenofovir; tenofovir disoproxil; tenofovir disoproxil fumarate; tenofovir alafenamide; tenofovir alafenamide hemifumarate; TRIUMEQ® (dolutegravir, abacavir, and lamivudine); dolutegravir, abacavir sulfate, and lamivudine; raltegravir; raltegravir and lamivudine; maraviroc; enfuvirtide; ALUVIA® (KALETRA®; lopinavir and ritonavir); COMBIVIR® (zidovudine and lamivudine; AZT+3TC); EPZICOM® (LIVEXA®; abacavir sulfate and lamivudine; ABC+3TC); TRIZIVIR® (abacavir sulfate, zidovudine, and lamivudine; ABC+AZT+3TC); rilpivirine; rilpivirine hydrochloride; atazanavir sulfate and cobicistat; atazanavir and cobicistat; darunavir and cobicistat; atazanavir; atazanavir sulfate; dolutegravir; elvitegravir; ritonavir; atazanavir sulfate and ritonavir; darunavir; lamivudine; prolastin; fosamprenavir; fosamprenavir calcium efavirenz; etravirine; nelfinavir; nelfinavir mesylate; interferon; didanosine; stavudine; indinavir; indinavir sulfate; tenofovir and lamivudine; zidovudine; nevirapine; saquinavir; saquinavir mesylate; aldesleukin; zalcitabine; tipranavir; amprenavir; delavirdine; delavirdine mesylate; Radha-108 (receptol); lamivudine and tenofovir disoproxil fumarate; efavirenz, lamivudine, and tenofovir disoproxil fumarate; phosphazid; lamivudine, nevirapine, and zidovudine; abacavir; and abacavir sulfate.

In some embodiments, an antibody disclosed herein, or a pharmaceutical composition thereof, is combined with an HIV nucleoside or nucleotide inhibitor of reverse transcriptase and an HIV non-nucleoside inhibitor of reverse transcriptase. In another specific embodiment, an antibody disclosed herein, or a pharmaceutical composition thereof, is combined with an HIV nucleoside or nucleotide inhibitor of reverse transcriptase, and an HIV protease inhibiting compound. In an additional embodiment, an antibody disclosed herein, or a pharmaceutical composition thereof, is combined with an HIV nucleoside or nucleotide inhibitor of reverse transcriptase, an HIV non-nucleoside inhibitor of reverse transcriptase, and a pharmacokinetic enhancer. In certain embodiments, an antibody disclosed herein, or a pharmaceutical composition thereof, is combined with at least one HIV nucleoside inhibitor of reverse transcriptase, an integrase inhibitor, and a pharmacokinetic enhancer. In another embodiment, an antibody disclosed herein, or a pharmaceutical composition thereof, is combined with two HIV nucleoside or nucleotide inhibitors of reverse transcriptase.

In a certain embodiment, an antibody disclosed herein, or a pharmaceutical composition thereof, is combined with abacavir sulfate, tenofovir, tenofovir disoproxil, tenofovir disoproxil fumarate, tenofovir disoproxil hemifumarate, tenofovir alafenamide, or tenofovir alafenamide hemifumarate.

In another embodiment, an antibody disclosed herein, or a pharmaceutical composition thereof, is combined with tenofovir, tenofovir disoproxil, tenofovir disoproxil fumarate, tenofovir alafenamide, or tenofovir alafenamide hemifumarate.

In yet another embodiment, an antibody disclosed herein, or a pharmaceutical composition thereof, is combined with a first additional therapeutic agent selected from the group consisting of abacavir sulfate, tenofovir, tenofovir disoproxil, tenofovir disoproxil fumarate, tenofovir alafenamide, and tenofovir alafenamide hemifumarate, and a second additional therapeutic agent selected from the group consisting of emtricitabine and lamivudine.

In another embodiment, an antibody disclosed herein, or a pharmaceutical composition thereof, is combined with a first additional therapeutic agent selected from the group consisting of tenofovir, tenofovir disoproxil, tenofovir disoproxil fumarate, tenofovir alafenamide, and tenofovir alafenamide hemifumarate, and a second additional therapeutic agent, wherein the second additional therapeutic agent is emtricitabine.

In some embodiments, an antibody disclosed herein, or a pharmaceutical composition thereof, is combined with a first additional therapeutic agent (a contraceptive) selected from the group consisting of cyproterone acetate, desogestrel, dienogest, drospirenone, estradiol valerate, ethinyl Estradiol, ethynodiol, etonogestrel, levomefolate, levonorgestrel, lynestrenol, medroxyprogesterone acetate, mestranol, mifepristone, misoprostol, nomegestrol acetate, norelgestromin, norethindrone, noretynodrel, norgestimate, ormeloxifene, segestersone acetate, ulipristal acetate, and any combinations thereof.

Gene Therapy and Cell Therapy

In certain embodiments, the antibodies or antigen-binding fragments described herein are combined with a gene or cell therapy regimen. Gene therapy and cell therapy include without limitation the genetic modification to silence a gene; genetic approaches to directly kill the infected cells; the infusion of immune cells designed to replace most of the patient's own immune system to enhance the immune response to infected cells, or activate the patient's own immune system to kill infected cells, or find and kill the infected cells; genetic approaches to modify cellular activity to further alter endogenous immune responsiveness against the infection. Examples of dendritic cell therapy include AGS-004. CCR5 gene editing agents include SB-728T. CCR5 gene inhibitors include Cal-1. In some embodiments, C34-CCR5/C34-CXCR4 expressing CD4-positive T-cells are co-administered with the herein described antibodies or antigen-binding fragments thereof. In some embodiments, the antibodies or antigen-binding fragments are co-administered with AGT-103-transduced autologous T-cell therapy or AAV-eCD4-Ig gene therapy.

Gene Editors

In certain embodiments, the antibodies or antigen-binding fragments described herein are combined with a gene editor, e.g., an HIV targeted gene editor. In various embodiments, the genome editing system can be selected from the group consisting of: a CRISPR/Cas9 complex, a zinc finger nuclease complex, a TALEN complex, a homing endonucleases complex, and a meganuclease complex. An illustrative HIV targeting CRISPR/Cas9 system includes without limitation EBT-101.

CAR-T-Cell Therapy

In some embodiments, the antibodies or antigen-binding fragments described herein can be co-administered with a population of immune effector cells engineered to express a chimeric antigen receptor (CAR), wherein the CAR comprises an HIV antigen binding domain. The HIV antigen include an HIV envelope protein or a portion thereof, gp120 or a portion thereof, a CD4 binding site on gp120, the CD4-induced binding site on gp120, N glycan on gp120, the V2 of gp120, the membrane proximal region on gp41. The immune effector cell is a T-cell or an NK cell. In some embodiments, the T-cell is a CD4+ T-cell, a CD8+ T-cell, or a combination thereof. Cells can be autologous or allogeneic. Examples of HIV CAR-T include VC-CAR-T, CMV-N6-CART, anti-CD4 CART-cell therapy, autologous hematopoietic stem cells genetically engineered to express a CD4 CAR and the C46 peptide.

TCR-T-Cell Therapy

In certain embodiments, the antibodies or antigen-binding fragments described herein are combined with a population of TCR-T-cells. TCR-T-cells are engineered to target HIV derived peptides present on the surface of virus-infected cells.

B-Cell Therapy

In certain embodiments, the antibodies or antigen-binding fragments described herein are combined with a population of B cells genetically modified to express broadly neutralizing antibodies, such as 3BNC117 (Hartweger, et al, *J Exp. Med.* 2019, 1301, Moffett, et al., *Sci. Immunol.* 4, eaax0644 (2019) 17 May 2019).

Kits

This disclosure also encompasses kits comprising one or more antibodies or antigen binding fragments, described herein, or conjugates thereof. In one instance, provided herein is a pharmaceutical pack or kit comprising one or more containers (e.g., vials, ampules) filled with one or more of the ingredients of the pharmaceutical compositions described herein, such as one or more antibodies provided herein. In some instances, the kits contain a pharmaceutical composition described herein. In one embodiment, kits comprising an antibody disclosed herein, or a pharmaceutical composition thereof, in combination with one or more (e.g., one, two, three, one or two, or one to three) additional therapeutic agents (such as those disclosed above) are provided.

In some embodiments, the kits comprise one or more unitary doses of the antibodies or antigen-binding fragments, or the polynucleotide or polynucleotides, in one or more containers. In some embodiments, the kits comprise one or more unitary doses of the antibodies or antigen-binding fragments and a second agent (e.g., one or more additional agents) for treating an HIV infection in separate containers. In some embodiments, the kits further comprise one or more unitary doses of a toll-like receptor (TLR) agonist. In some embodiments, the TLR agonist is a TLR7 agonist or a TLR8 agonist. In some embodiments, the TLR7 agonist is selected from the group consisting of vesatolimod, imiquimod, and resiquimod. In some embodiments, the kits comprise one or more unitary doses of the antibodies or antigen-binding fragments, as described herein, and one or more unitary doses of a second, third or fourth anti-HIV antibody, or antigen-binding fragments thereof, wherein the second, third or fourth anti-HIV antibodies, or antigen-binding fragments thereof, bind to epitopes or regions of gp120 selected from the group consisting of: (i) third variable loop (V3) and/or high mannose patch comprising a N332 oligomannose glycan; (ii) second variable loop (V2) and/or Env trimer apex; (iii) gp120/gp41 interface; or (iv) silent face of gp120. In some embodiments, the second anti-HIV antibody or antigen-binding fragment thereof, binds to the third variable loop (V3) and/or high mannose patch comprising a N332 oligomannose glycan. In some embodiments, the second anti-HIV antibody competes with or comprises VH and VL regions from an antibody selected from the group consisting of GS-9722, PGT-121, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the second anti-HIV antibody or antigen binding fragments thereof competes with or comprises VH and VL regions from an antibody selected from the group consisting of GS-9722 and PGT-121. In some embodiments, the kits comprise two or more unitary doses, wherein the unitary doses are the same. In some embodiments, the kits comprise two or more unitary doses, wherein the unitary doses are different.

Optionally associated with such container(s) can be a notice in the form prescribed by a governmental agency regulating the manufacture, use or sale of pharmaceuticals or biological products, which notice reflects approval by the agency of manufacture, use or sale for human administration.

EXAMPLES

The following examples are provided to illustrate the various embodiments and are not to be interpreted as limiting the scope of the present application. To the extent that specific materials are mentioned, it is merely for purposes of illustration and is not intended to limit the present application. One skilled in the art can develop equivalent means or reactants without the exercise of inventive capacity and without departing from the scope of the present application.

Example 1: ADCC Activity of Antibody A

ADCC of HIV-infected target $CD4^+$ T cells by the antibodies were assayed in vitro using HIV-infected CEM.NKr.$CCR5^+Luc^+$ cells and primary human NK effector cells from independent healthy donors.

The study included both PGT121-sensitive and PGT121-resistant viruses and antibodies having modifications to the Fc (Fc-modified) of Antibody A. Table 1 summarizes the killing potency and efficacy of Antibodies A, A-1, A-2, A-3, A-4, A-5 and A-6, when assayed in the presence of 5 mg/mL of human serum IgG and using primary human NK cells from three independent human donors and CEM.NKr.$CCR5^+Luc^+$ cells infected with viral isolates 92US712 or 92US657.

TABLE 1

| | ADCC activity | | | | | | | |
|---|---|---|---|---|---|---|---|---|
| | ID: | A | A-2 | A-1 | A-3 | A-4 | A-5 | A-6 |
| 92US712-infected cells | | | | | | | | |
| Emax (%) | NK Donor 1 | 48 | 76 | 77 | 77 | 78 | 79 | 68 |
| | NK Donor 2 | 7 | 60 | 62 | 59 | 61 | 61 | 54 |
| | NK Donor 3 | 27 | 60 | 62 | 67 | 64 | 66 | 51 |
| $EC_{50}$ | NK Donor 1 | 2.23 | 0.18 | 0.19 | 0.07 | 0.20 | 0.19 | 0.27 |
| (µg/mL) | NK Donor 2 | >100 | 0.08 | 0.09 | 0.08 | 0.13 | 0.08 | 0.54 |
| | NK Donor 3 | 3.63 | 0.20 | 0.16 | 0.20 | 0.40 | 0.09 | 0.18 |

TABLE 1-continued

| | ID: | A | A-2 | A-1 | A-3 | A-4 | A-5 | A-6 |
|---|---|---|---|---|---|---|---|---|
| 92US657-infected cells | | | | | | | | |
| Emax (%) | NK Donor 1 | 2 | 59 | 58 | 49 | 52 | 58 | 54 |
| | NK Donor 2 | 0 | 51 | 50 | 49 | 53 | 61 | 53 |
| | NK Donor 3 | 0 | 56 | 52 | 56 | 50 | 61 | 52 |
| $EC_{50}$ (μg/mL) | NK Donor 1 | >100 | 0.54 | 0.74 | 0.68 | 0.60 | 0.57 | 3.93 |
| | NK Donor 2 | >100 | 0.81 | 0.55 | 0.67 | 1.21 | 0.83 | 1.21 |
| | NK Donor 3 | >100 | 1.13 | 0.37 | 1.39 | 1.64 | 0.76 | 3.21 |

$EC_{50}$ noted as >100 μg/mL for dose responses with Emax <10%

The Fc-modified antibodies exhibited increased killing of HIV-1-infected target CD4 T cells compared to Antibody A in vitro by primary human NK cells from independent donors and target cells infected with different viral isolates (Table 1). Antibody A-mediated minimal killing (Emax<10%) with primary NK cells from some donors, while with NK cells from other donors killing was detectable. Compared to Antibody A, the Fc-modified antibodies exhibited increased potency ($EC_{50}$) and maximum killing (Emax) of HIV-1-infected cells, as observed in ADCC assays performed with primary human NK cells from three independent healthy donors (Table 1). The increase in potency observed ranged from about 10- to 40-fold with donors where Antibody A was active. A panel of 22 infected target cell cultures was generated by infecting CEM.NK-r.CCR5+Luc+ cells with 22 unique viral clones resistant to neutralization (e.g., infected cell killing) by PGT121.60 (see, WO 2017/106346). ADCC activity and breadth of Antibody A-1 and Antibody PGT121.60 were evaluated against this panel of infected target cells using primary human NK effector cells from healthy donors in the absence of competing serum IgG. 86% (19/22) of the infected target cell cultures resistant to ADCC by PGT121.60 were killed by Antibody A-1 ($E_{max}$>30%). Antibody A-1 mediated ADCC of cells infected with HIV strains that were resistant to PGT121.60. The results of this assessment are summarized in Table 2.

TABLE 2

Infected cell killing of PGT121.60 resistant by Antibody A-1 and Antibody PGT121.60. Numbers depict ADCC Emax (%) average from two donors.

| | ADCC Emax (%) | |
|---|---|---|
| Virus | PGT121.60 | Antibody A-1 |
| VS001 | 1.0 | 26.8 |
| VS002 | 2.0 | 22.9 |
| VS003 | 3.0 | 44.4 |
| VS004 | 4.0 | 31.7 |
| VS007 | 9 | 45 |
| VS008 | 22 | 60 |
| VS010 | 10 | 69 |
| VS011 | 8.0 | 34.6 |
| VS017 | 9.0 | 40.5 |
| VS023 | 10.0 | 0.8 |
| VS026 | 11.0 | 31.3 |
| VS029 | 12.0 | 1.5 |
| VS030 | 13.0 | 39.3 |
| VS032 | 14.0 | 29.1 |
| VS033 | 15.0 | 31.1 |
| VS034 | 16.0 | 40.6 |
| VS038 | 17.0 | 36.1 |
| VS042 | 18.0 | 39.6 |
| VS044 | 19.0 | 31.4 |
| VS046 | 20.0 | 41.9 |
| VS049 | 21.0 | 7.8 |
| VS052 | 22.0 | 34.0 |

Antibody-dependent cellular cytotoxicity was also evaluated using HIV-infected primary CD4+ T cells as target cells and autologous primary NK cells, monocytes and neutrophils as effector cells.

The NK cells, monocytes and CD4+ T cells were isolated from PBMCs obtained from healthy donors, while neutrophils were isolated from whole blood from healthy donors. Total CD4+ T cells were spinfected in the absence of T-cell activation to maintain low cell surface antigen expression levels and potentially mimic antigen expression levels on latently infected CD4+ T cells. Viral isolates used were 8176 and 92US076 (antibody A neutralization sensitive) and 8398 (antibody A neutralization resistant). Assays were performed in the presence of 1 mg/ml nonspecific human serum IgG which compete with effector mAbs for FcγR binding. Antibody-dependent killing was measured by the reduction in p24+ CD4 T cells using flow cytometry.

The killing AUC, $EC_{50}$ (μg/mL) and Emax (%) values are tabulated in Table 3-11

TABLE 3

Killing AUC by NK cells

| | | AUC (NK) | | | |
|---|---|---|---|---|---|
| Virus | Donor | A | A-1 | 1.52.64-1 | PGT121.60 |
| 8176 | 0117 | 49 | 108 | 103 | 168 |
| | 3594 | 18 | 142 | 139 | 205 |
| 302076 | 0117 | 26 | 116 | 78 | 18 |
| | 3594 | 28 | 76 | 101 | 26 |
| 8398 | 0117 | 20 | 4 | 0 | 203 |
| | 3594 | 0 | 6 | 15 | 211 |

TABLE 4

Killing EC50 by NK cells

| | | EC50 (NK) | | | |
|---|---|---|---|---|---|
| Virus | Donor | A | A-1 | 1.52.64-1 | PGT121.60 |
| 8176 | 0117 | >100 | 1.101 | 0.949 | 0.246 |
| | 3594 | >100 | 0.518 | 1.350 | 0.051 |

TABLE 4-continued

Killing EC50 by NK cells

| | | EC50 (NK) | | | |
|---|---|---|---|---|---|
| Virus | Donor | A | A-1 | 1.52.64-1 | PGT121.60 |
| 302076 | 0117 | >100 | 1.701 | 7.602 | 100.000 |
| | 3594 | >100 | 2.613 | 3.114 | 72.050 |
| 8398 | 0117 | >100 | >100 | >100 | 0.339 |
| | 3594 | >100 | >100 | >100 | 0.220 |

TABLE 5

Killing Emax by NK cells

| | | Emax (NK) | | | |
|---|---|---|---|---|---|
| Virus | Donor | A | A-1 | 1.52.64-1 | PGT121.60 |
| 8176 | 0117 | <20 | 56 | 54 | 65 |
| | 3594 | <20 | 62 | 69 | 62 |
| 302076 | 0117 | <20 | 68 | 69 | 20 |
| | 3594 | <20 | 49 | 64 | 45 |
| 8398 | 0117 | <20 | <20 | <20 | 79 |
| | 3594 | <20 | <20 | <20 | 81 |

TABLE 6

Killing AUC by monocytes

| | | AUC (Monocytes) | | | |
|---|---|---|---|---|---|
| Virus | Donor | A | A-1 | 1.52.64-1 | PGT121.60 |
| 8176 | 0117 | 0 | 83 | 87 | 122 |
| | 3594 | 17 | 141 | 159 | 157 |
| 302076 | 0117 | 24 | 54 | 61 | 24 |
| | 3594 | 138 | 166 | 158 | 108 |
| 8398 | 0117 | 0 | 0 | 4 | 53 |
| | 3594 | 0 | 13 | 4 | 186 |

TABLE 7

Killing EC50 by monocytes

| | | EC50 (Monocytes) | | | |
|---|---|---|---|---|---|
| Virus | Donor | A | A-1 | 1.52.64-1 | PGT121.60 |
| 8176 | 0117 | >100 | 0.402 | 0.490 | 0.232 |
| | 3594 | >100 | 0.309 | 0.202 | 0.010 |
| 302076 | 0117 | 10.570 | 6.514 | 7.236 | >100 |
| | 3594 | 0.006 | 0.062 | 0.088 | 0.019 |
| 8398 | 0117 | >100 | >100 | >100 | 0.728 |
| | 3594 | >100 | >100 | >100 | 0.201 |

TABLE 8

Killing Emax by monocytes

| | | Emax (Monocytes) | | | |
|---|---|---|---|---|---|
| Virus | Donor | A | A-1 | 1.52.64-1 | PGT121.60 |
| 8176 | 0117 | <20 | 34 | 35 | 44 |
| | 3594 | <20 | 47 | 57 | 40 |
| 302076 | 0117 | 24 | 46 | 47 | 20 |
| | 3594 | 33 | 49 | 54 | 30 |
| 8398 | 0117 | <20 | <20 | <20 | 25 |
| | 3594 | <20 | <20 | <20 | 67 |

TABLE 9

Killing AUC by neutrophils

| | | AUC (Neutrophils) | | | |
|---|---|---|---|---|---|
| Virus | Donor | A | A-1 | 1.52.64-1 | PGT121.60 |
| 8176 | 92132 | 41 | 74 | 89 | 125 |
| | 92602 | 21 | 47 | 45 | 71 |

TABLE 10

Killing EC50 by neutrophils

| | | EC50 (Neutrophils) | | | |
|---|---|---|---|---|---|
| Virus | Donor | A | A-1 | 1.52.64-1 | PGT121.60 |
| 8176 | 92132 | >100 | 0.231 | 0.307 | 0.012 |
| | 92602 | >100 | 1.097 | 0.199 | 0.232 |

TABLE 11

Killing Emax by neutrophils

| | | Emax (Neutrophils) | | | |
|---|---|---|---|---|---|
| Virus | Donor | A | A-1 | 1.52.64-1 | PGT121.60 |
| 8176 | 92132 | <20 | 29 | 37 | 34 |
| | 92602 | <20 | 23 | <20 | 25 |

The results presented in Tables 3-11 demonstrate that, consistent with NK-mediated ADCC of CEM cells, the Fc-engineered mAbs (1.52.64-1, A-1 and PGT121.60) also exhibited increased killing of HIV-infected primary CD4 T cells by NK cells, monocytes and neutrophils compared to Antibody A.

Example 2: Antibody Campaign

The sequences of Antibody A and Antibody B were compared to the human germline, revealing several mutations, insertions and deletions both inside and outside of the CDRs. Briefly, a contiguous region of germline mismatch in heavy chain framework region 3 (HC FR3) was identified at position 72-78 of the heavy chain (HC). Four amino acid insertions were identified between position 74 and 75 in HC FR3. A germline deletion was identified in CDR L1 at positions 27-30 of the light chain (LC). A contiguous region of germline mismatch was identified in light chain framework region 3 (LC FR3) at position 65-77. A N72 linked consensus glycosylation motif was identified in LC FR3 at position 72-74. A germline deletion in CDR L3 was identified at position 92-95. Two residues that are highly conserved in human IgG light chains (F98 and G99) were mutated in both Antibody A and Antibody B.

Mass spectrometry studies of EXPICHO' expressed Antibody A were conducted to determine whether there was glycosylation at LC position 72-74. Accelerated stress and potency assays were conducted to see if there were any chemical liabilities (e.g. oxidation, deamidation etc.) present in antibody A or its variants. Due to the high degree of somatic hypermutation, T-cell epitope mapping of the primary sequence was conducted to identify potentially immunogenic motifs. Additionally, an iterative protein engineering campaign was conducted in order to generate new antibodies without the N72 glycosylation motif and/or with a closer overall match to the human germline. Without being bound to any theories, this campaign may yield new antibodies that have desired properties including but not limited to a reduced risk of immunogenicity, HIV neutralization potency and breadth equal to or better than Antibody A or Antibody B, and/or improved biophysical and development properties.

Table 12 provides the SEQ ID NOs of the VH and VL CDRs (according to the Kabat definition) of the anti-gp120 antibodies disclosed herein.

TABLE 12

SEQ ID NOs of the VH and VL CDRs of Antibodies

| Antibody Name | VHCDR1 | VHCDR2 | VHCDR3 | VLCDR1 | VLCDR2 | VLCDR3 |
|---|---|---|---|---|---|---|
| A-1 | 137 | 138 | 139 | 140 | 141 | 142 |
| A | 137 | 138 | 139 | 140 | 141 | 142 |
| 1v2-1 | 137 | 138 | 139 | 140 | 141 | 142 |
| 1.2.1-1 | 137 | 138 | 139 | 140 | 141 | 142 |
| 1.1.2-1 | 137 | 138 | 139 | 140 | 141 | 142 |
| 1.2.2-1 | 137 | 138 | 139 | 140 | 141 | 142 |
| 1.3.1-1 | 137 | 138 | 139 | 140 | 141 | 142 |
| 1.4.1-1 | 137 | 138 | 139 | 140 | 141 | 142 |
| 1.5.1-1 | 137 | 138 | 139 | 140 | 141 | 142 |
| 1.6.1-1 | 137 | 138 | 139 | 140 | 141 | 142 |
| 1.7.1-1 | 137 | 138 | 139 | 140 | 141 | 142 |
| 1.8.1-1 | 137 | 138 | 139 | 140 | 141 | 142 |
| 1.9.1-1 | 137 | 138 | 139 | 140 | 141 | 142 |
| 1.10.1-1 | 159 | 138 | 139 | 140 | 141 | 142 |
| 1.11.1-1 | 159 | 138 | 139 | 140 | 141 | 142 |
| 1.15.1-1 | 137 | 160 | 139 | 140 | 141 | 142 |
| 1.16.1-1 | 137 | 161 | 139 | 140 | 141 | 142 |
| 1.17.1-1 | 137 | 162 | 139 | 140 | 141 | 142 |
| 1.18.1-1 | 137 | 163 | 139 | 140 | 141 | 142 |
| 1.19.1-1 | 137 | 138 | 139 | 140 | 141 | 142 |
| 1.20.1-1 | 137 | 138 | 139 | 140 | 141 | 142 |
| 1.21.1-1 | 137 | 138 | 139 | 140 | 141 | 142 |
| 1.22.1-1 | 137 | 138 | 139 | 140 | 141 | 142 |
| 1.24.1-1 | 137 | 138 | 139 | 140 | 141 | 142 |
| 1.25.1-1 | 137 | 138 | 139 | 140 | 141 | 142 |
| 1.26.1-1 | 137 | 138 | 139 | 140 | 141 | 142 |
| 1.27.1-1 | 137 | 138 | 164 | 140 | 141 | 142 |
| 1.28.1-1 | 137 | 138 | 164 | 140 | 141 | 142 |
| 1.29.1-1 | 137 | 138 | 139 | 140 | 141 | 142 |
| 1.30.1-1 | 137 | 138 | 139 | 140 | 141 | 142 |
| 1.1.3-1 | 137 | 138 | 139 | 140 | 141 | 142 |
| 1.1.4-1 | 137 | 138 | 139 | 140 | 141 | 142 |
| 1.1.5-1 | 137 | 138 | 139 | 140 | 141 | 142 |
| 1.1.6-1 | 137 | 138 | 139 | 140 | 165 | 142 |
| 1.1.7-1 | 137 | 138 | 139 | 140 | 166 | 142 |
| 1.1.8-1 | 137 | 138 | 139 | 140 | 168 | 142 |
| 1.1.9-1 | 137 | 138 | 139 | 140 | 167 | 142 |
| 1.1.10-1 | 137 | 138 | 139 | 140 | 141 | 142 |
| 1.1.11-1 | 137 | 138 | 139 | 140 | 141 | 142 |
| 1.1.12-1 | 137 | 138 | 139 | 140 | 141 | 142 |
| 1.1.13-1 | 137 | 138 | 139 | 140 | 141 | 142 |
| 1.1.14-1 | 137 | 138 | 139 | 140 | 141 | 142 |
| 1.1.15-1 | 137 | 138 | 139 | 140 | 141 | 142 |
| 1.1.16-1 | 137 | 138 | 139 | 140 | 141 | 142 |
| 1.1.17-1 | 137 | 138 | 139 | 140 | 141 | 142 |
| 1.1.18-1 | 137 | 138 | 139 | 140 | 141 | 142 |
| 1.1.19-1 | 137 | 138 | 139 | 140 | 141 | 142 |
| 1.1.20-1 | 137 | 138 | 139 | 140 | 141 | 142 |
| 1.1.21-1 | 137 | 138 | 139 | 140 | 141 | 142 |
| 1.1.22-1 | 137 | 138 | 139 | 140 | 141 | 142 |
| 1.1.23-1 | 137 | 138 | 139 | 140 | 141 | 142 |
| 1.1.24-1 | 137 | 138 | 139 | 140 | 141 | 142 |
| 1.1.25-1 | 137 | 138 | 139 | 140 | 141 | 142 |
| 1.1.26-1 | 137 | 138 | 139 | 140 | 141 | 142 |
| 1.1.27-1 | 137 | 138 | 139 | 140 | 141 | 142 |
| 1.1.28-1 | 137 | 138 | 139 | 140 | 141 | 142 |
| 1.1.29-1 | 137 | 138 | 139 | 140 | 141 | 142 |
| 1.1.30-1 | 137 | 138 | 139 | 140 | 141 | 142 |
| 1.12.15-1 | 137 | 138 | 139 | 140 | 141 | 142 |
| 1.13.15-1 | 137 | 138 | 139 | 140 | 141 | 142 |
| 1.14.15-1 | 137 | 138 | 139 | 140 | 141 | 142 |
| 1.12.17-1 | 137 | 138 | 139 | 140 | 141 | 142 |
| 1.13.17-1 | 137 | 138 | 139 | 140 | 141 | 142 |
| 1.14.17-1 | 137 | 138 | 139 | 140 | 141 | 142 |
| 1.31.1-1 | 137 | 138 | 139 | 140 | 141 | 142 |
| 1.32.1-1 | 137 | 138 | 139 | 140 | 141 | 142 |

TABLE 12-continued

SEQ ID NOs of the VH and VL CDRs of Antibodies

| Antibody Name | VHCDR1 | VHCDR2 | VHCDR3 | VLCDR1 | VLCDR2 | VLCDR3 |
|---|---|---|---|---|---|---|
| 1.33.1-1 | 137 | 138 | 139 | 140 | 141 | 142 |
| 1.34.1-1 | 137 | 138 | 164 | 140 | 141 | 142 |
| 1.35.1-1 | 159 | 138 | 164 | 140 | 141 | 142 |
| 1.36.1-1 | 159 | 138 | 164 | 140 | 141 | 142 |
| 1.1.31-1 | 137 | 138 | 139 | 140 | 141 | 142 |
| 1.31.31-1 | 137 | 138 | 139 | 140 | 141 | 142 |
| 1.32.31-1 | 137 | 138 | 139 | 140 | 141 | 142 |
| 1.33.31-1 | 137 | 138 | 139 | 140 | 141 | 142 |
| 1.34.31-1 | 137 | 138 | 164 | 140 | 141 | 142 |
| 1.35.31-1 | 159 | 138 | 164 | 140 | 141 | 142 |
| 1.36.31-1 | 159 | 138 | 164 | 140 | 141 | 142 |
| 1.1.32-1 | 137 | 138 | 139 | 140 | 141 | 142 |
| 1.31.32-1 | 137 | 138 | 139 | 140 | 141 | 142 |
| 1.32.32-1 | 137 | 138 | 139 | 140 | 141 | 142 |
| 1.33.32-1 | 137 | 138 | 139 | 140 | 141 | 142 |
| 1.34.32-1 | 137 | 138 | 164 | 140 | 141 | 142 |
| 1.35.32-1 | 159 | 138 | 164 | 140 | 141 | 142 |
| 1.36.32-1 | 159 | 138 | 164 | 140 | 141 | 142 |
| 1.1.33-1 | 137 | 138 | 139 | 140 | 166 | 142 |
| 1.31.33-1 | 137 | 138 | 139 | 140 | 166 | 142 |
| 1.32.33-1 | 137 | 138 | 139 | 140 | 166 | 142 |
| 1.33.33-1 | 137 | 138 | 139 | 140 | 166 | 142 |
| 1.34.33-1 | 137 | 138 | 164 | 140 | 166 | 142 |
| 1.35.33-1 | 159 | 138 | 164 | 140 | 166 | 142 |
| 1.36.33-1 | 159 | 138 | 164 | 140 | 166 | 142 |
| 1.1.34-1 | 137 | 138 | 139 | 140 | 166 | 142 |
| 1.31.34-1 | 137 | 138 | 139 | 140 | 166 | 142 |
| 1.32.34-1 | 137 | 138 | 139 | 140 | 166 | 142 |
| 1.33.34-1 | 137 | 138 | 139 | 140 | 166 | 142 |
| 1.34.34-1 | 137 | 138 | 164 | 140 | 166 | 142 |
| 1.35.34-1 | 159 | 138 | 164 | 140 | 166 | 142 |
| 1.36.34-1 | 159 | 138 | 164 | 140 | 166 | 142 |
| 1.1.35-1 | 137 | 138 | 139 | 140 | 166 | 142 |
| 1.31.35-1 | 137 | 138 | 139 | 140 | 166 | 142 |
| 1.32.35-1 | 137 | 138 | 139 | 140 | 166 | 142 |
| 1.33.35-1 | 137 | 138 | 139 | 140 | 166 | 142 |
| 1.34.35-1 | 137 | 138 | 164 | 140 | 166 | 142 |
| 1.35.35-1 | 159 | 138 | 164 | 140 | 166 | 142 |
| 1.36.35-1 | 159 | 138 | 164 | 140 | 166 | 142 |
| 1.1.36-1 | 137 | 138 | 139 | 140 | 166 | 142 |
| 1.31.36-1 | 137 | 138 | 139 | 140 | 166 | 142 |
| 1.32.36-1 | 137 | 138 | 139 | 140 | 166 | 142 |
| 1.33.36-1 | 137 | 138 | 139 | 140 | 166 | 142 |
| 1.34.36-1 | 137 | 138 | 164 | 140 | 166 | 142 |
| 1.35.36-1 | 159 | 138 | 164 | 140 | 166 | 142 |
| 1.36.36-1 | 159 | 138 | 164 | 140 | 166 | 142 |
| 1.1.37-1 | 137 | 138 | 139 | 140 | 141 | 142 |
| 1.1.38-1 | 137 | 138 | 139 | 140 | 141 | 142 |
| 1.1.39-1 | 137 | 138 | 139 | 140 | 141 | 142 |
| 1.1.40-1 | 137 | 138 | 139 | 140 | 141 | 142 |
| 1.1.41-1 | 137 | 138 | 139 | 140 | 141 | 142 |
| 1.1.42-1 | 137 | 138 | 139 | 140 | 141 | 142 |
| 1.1.43-1 | 137 | 138 | 139 | 140 | 141 | 142 |
| 1.1.44-1 | 137 | 138 | 139 | 140 | 141 | 142 |
| 1.1.45-1 | 137 | 138 | 139 | 140 | 141 | 142 |
| 1.1.46-1 | 137 | 138 | 139 | 140 | 141 | 142 |
| 1.1.47-1 | 137 | 138 | 139 | 140 | 141 | 142 |
| 1.1.48-1 | 137 | 138 | 139 | 140 | 141 | 142 |
| 1.1.49-1 | 137 | 138 | 139 | 140 | 141 | 142 |
| 1.37.51-1 | 137 | 138 | 139 | 140 | 141 | 142 |
| 1.8.52-1 | 137 | 138 | 139 | 140 | 141 | 142 |
| 1.1.54-1 | 137 | 138 | 139 | 140 | 141 | 142 |
| A-2 | 137 | 138 | 139 | 140 | 141 | 142 |
| B-1 | 153 | 138 | 154 | 140 | 141 | 142 |
| 2.1.2-1 | 153 | 138 | 154 | 140 | 141 | 142 |
| 1.1.64-1 | 137 | 138 | 139 | 140 | 141 | 142 |
| 1.1.67-1 | 137 | 138 | 139 | 140 | 141 | 142 |
| 1.1.72-1 | 137 | 138 | 139 | 140 | 141 | 142 |
| 1.1.75-1 | 137 | 138 | 139 | 140 | 141 | 142 |
| 1.1.78-1 | 137 | 138 | 139 | 140 | 141 | 142 |
| A-3 | 137 | 138 | 139 | 140 | 141 | 142 |
| A-4 | 137 | 138 | 139 | 140 | 141 | 142 |
| A-5 | 137 | 138 | 139 | 140 | 141 | 142 |
| A-6 | 137 | 138 | 139 | 140 | 141 | 142 |
| 1.41.5-1 | 137 | 138 | 139 | 140 | 141 | 142 |
| 1.41.81-1 | 137 | 138 | 139 | 140 | 141 | 142 |

TABLE 12-continued

SEQ ID NOs of the VH and VL CDRs of Antibodies

| Antibody Name | VHCDR1 | VHCDR2 | VHCDR3 | VLCDR1 | VLCDR2 | VLCDR3 |
|---|---|---|---|---|---|---|
| 1.1.82-1 | 137 | 138 | 139 | 140 | 141 | 142 |
| 1.41.83-1 | 137 | 138 | 139 | 140 | 141 | 142 |
| 1.1.84-1 | 137 | 138 | 139 | 140 | 141 | 142 |
| 1.41.85-1 | 137 | 138 | 139 | 140 | 141 | 142 |
| 1.41.86-1 | 137 | 138 | 139 | 140 | 141 | 142 |
| 1.41.87-1 | 137 | 138 | 139 | 140 | 141 | 142 |
| 1.1.88-1 | 137 | 138 | 139 | 140 | 141 | 142 |
| 1.41.89-1 | 137 | 138 | 139 | 140 | 141 | 142 |
| 1.1.90-1 | 137 | 138 | 139 | 140 | 141 | 142 |
| 1.41.91-1 | 137 | 138 | 139 | 140 | 141 | 142 |
| 1.41.92-1 | 137 | 138 | 139 | 140 | 141 | 142 |
| 1.41.93-1 | 137 | 138 | 139 | 140 | 141 | 142 |
| 1.1.94-1 | 137 | 138 | 139 | 140 | 141 | 142 |
| 1.41.95-1 | 137 | 138 | 139 | 140 | 141 | 142 |
| 1.1.96-1 | 137 | 138 | 139 | 140 | 141 | 142 |
| 1.41.97-1 | 137 | 138 | 139 | 140 | 141 | 142 |
| 1.41.98-1 | 137 | 138 | 139 | 140 | 141 | 142 |
| 1.41.99-1 | 137 | 138 | 139 | 140 | 141 | 142 |
| 1.1.100-1 | 137 | 138 | 139 | 140 | 141 | 142 |
| 1.41.101-1 | 137 | 138 | 139 | 140 | 141 | 142 |
| 1.1.102-1 | 137 | 138 | 139 | 140 | 141 | 142 |
| 1.41.103-1 | 137 | 138 | 139 | 140 | 141 | 142 |
| 1.1.110-1 | 137 | 138 | 139 | 140 | 141 | 142 |
| 1.1.111-1 | 137 | 138 | 139 | 140 | 141 | 142 |
| 1.1.112-1 | 137 | 138 | 139 | 140 | 141 | 142 |
| 1.1.113-1 | 137 | 138 | 139 | 140 | 141 | 142 |
| 2.1.3-1 | 153 | 138 | 154 | 140 | 141 | 142 |
| 2.1.4-1 | 153 | 138 | 154 | 140 | 141 | 142 |
| 2.2.1-1 | 137 | 138 | 139 | 140 | 141 | 142 |
| 2.3.1-1 | 153 | 138 | 139 | 140 | 141 | 142 |
| 3.1.8-1 | 137 | 138 | 139 | 140 | 141 | 142 |
| 2.2.8-1 | 137 | 138 | 139 | 140 | 141 | 142 |
| 2.3.8-1 | 153 | 138 | 139 | 140 | 141 | 142 |
| 3.1.9-1 | 137 | 138 | 139 | 140 | 141 | 142 |
| 2.2.9-1 | 137 | 138 | 139 | 140 | 141 | 142 |
| 2.3.9-1 | 153 | 138 | 139 | 140 | 141 | 142 |
| 1.1.115-1 | 137 | 138 | 139 | 140 | 141 | 142 |
| 3.1.10-1 | 137 | 138 | 139 | 140 | 141 | 142 |
| 2.2.10-1 | 137 | 138 | 139 | 140 | 141 | 142 |
| 2.3.10-1 | 153 | 138 | 139 | 140 | 141 | 142 |
| 1.1.116-1 | 137 | 138 | 139 | 140 | 141 | 142 |
| 3.1.11-1 | 137 | 138 | 139 | 140 | 141 | 142 |
| 2.2.11-1 | 137 | 138 | 139 | 140 | 141 | 142 |
| 2.3.11-1 | 153 | 138 | 139 | 140 | 141 | 142 |
| 1.1.117-1 | 137 | 138 | 139 | 140 | 141 | 142 |
| 3.1.12-1 | 137 | 138 | 139 | 140 | 141 | 142 |
| 2.2.12-1 | 137 | 138 | 139 | 140 | 141 | 142 |
| 2.3.12-1 | 153 | 138 | 139 | 140 | 141 | 142 |
| 1.1.118-1 | 137 | 138 | 139 | 140 | 141 | 142 |
| 3.1.13-1 | 137 | 138 | 139 | 140 | 141 | 142 |
| 2.2.13-1 | 137 | 138 | 139 | 140 | 141 | 142 |
| 2.3.13-1 | 153 | 138 | 139 | 140 | 141 | 142 |
| 3.1.14-1 | 137 | 138 | 139 | 140 | 141 | 142 |
| 2.2.14-1 | 137 | 138 | 139 | 140 | 141 | 142 |
| 2.3.14-1 | 153 | 138 | 139 | 140 | 141 | 142 |
| 3.1.5-1 | 137 | 138 | 139 | 140 | 141 | 142 |
| 2.2.5-1 | 137 | 138 | 139 | 140 | 141 | 142 |
| 2.3.5-1 | 153 | 138 | 139 | 140 | 141 | 142 |
| 3.1.15-1 | 137 | 138 | 139 | 140 | 141 | 142 |
| 2.2.15-1 | 137 | 138 | 139 | 140 | 141 | 142 |
| 2.3.15-1 | 153 | 138 | 139 | 140 | 141 | 142 |
| 1.1.119-1 | 137 | 138 | 139 | 140 | 141 | 142 |
| 3.1.7-1 | 137 | 138 | 139 | 140 | 141 | 142 |
| 2.2.7-1 | 137 | 138 | 139 | 140 | 141 | 142 |
| 2.3.7-1 | 153 | 138 | 139 | 140 | 141 | 142 |
| 3.1.2-1 | 137 | 138 | 139 | 140 | 141 | 142 |
| 2.2.2-1 | 137 | 138 | 139 | 140 | 141 | 142 |
| 2.3.2-1 | 153 | 138 | 139 | 140 | 141 | 142 |
| 3.1.16-1 | 137 | 138 | 139 | 140 | 141 | 142 |
| 2.2.16-1 | 137 | 138 | 139 | 140 | 141 | 142 |
| 2.3.16-1 | 153 | 138 | 139 | 140 | 141 | 142 |
| 3.1.17-1 | 137 | 138 | 139 | 140 | 141 | 142 |
| 2.2.17-1 | 137 | 138 | 139 | 140 | 141 | 142 |
| 2.3.17-1 | 153 | 138 | 139 | 140 | 141 | 142 |
| 3.1.18-1 | 137 | 138 | 139 | 140 | 141 | 142 |
| 2.2.18-1 | 137 | 138 | 139 | 140 | 141 | 142 |

TABLE 12-continued

SEQ ID NOs of the VH and VL CDRs of Antibodies

| Antibody Name | VHCDR1 | VHCDR2 | VHCDR3 | VLCDR1 | VLCDR2 | VLCDR3 |
|---|---|---|---|---|---|---|
| 2.3.18-1 | 153 | 138 | 139 | 140 | 141 | 142 |
| 1.1.120-1 | 137 | 138 | 139 | 140 | 141 | 142 |
| 3.1.19-1 | 137 | 138 | 139 | 140 | 141 | 142 |
| 2.2.19-1 | 137 | 138 | 139 | 140 | 141 | 142 |
| 2.3.19-1 | 153 | 138 | 139 | 140 | 141 | 142 |
| 1.1.121-1 | 137 | 138 | 139 | 140 | 141 | 142 |
| 3.1.20-1 | 137 | 138 | 139 | 140 | 141 | 142 |
| 2.2.20-1 | 137 | 138 | 139 | 140 | 141 | 142 |
| 2.3.20-1 | 153 | 138 | 139 | 140 | 141 | 142 |
| 1.1.122-1 | 137 | 138 | 139 | 140 | 141 | 142 |
| 1.1.123-1 | 137 | 138 | 139 | 140 | 141 | 142 |
| 1.1.124-1 | 137 | 138 | 139 | 140 | 141 | 142 |
| 1.1.125-1 | 137 | 138 | 139 | 140 | 141 | 142 |
| 1.1.126-1 | 137 | 138 | 139 | 140 | 141 | 142 |
| 1.1.127-1 | 137 | 138 | 139 | 140 | 141 | 142 |
| 1.1.128-1 | 137 | 138 | 139 | 140 | 141 | 142 |
| 1.1.129-1 | 137 | 138 | 139 | 140 | 141 | 142 |
| 1.1.130-1 | 137 | 138 | 139 | 140 | 141 | 142 |
| 1.1.131-1 | 137 | 138 | 139 | 140 | 141 | 142 |
| 1.1.132-1 | 137 | 138 | 139 | 140 | 141 | 142 |
| 1.1.133-1 | 137 | 138 | 139 | 140 | 141 | 142 |
| 1.1.134-1 | 137 | 138 | 139 | 140 | 141 | 142 |
| 1.1.135-1 | 137 | 138 | 139 | 140 | 141 | 142 |
| 1.1.138-1 | 137 | 138 | 139 | 570 | 141 | 142 |
| 1.42.1-1 | 137 | 138 | 139 | 140 | 141 | 142 |
| 1.43.1-1 | 137 | 138 | 139 | 140 | 141 | 142 |
| 1.44.1-1 | 137 | 138 | 139 | 140 | 141 | 142 |
| 1.45.1-1 | 137 | 138 | 139 | 140 | 141 | 142 |
| 1.46.1-1 | 153 | 138 | 139 | 140 | 141 | 142 |
| 1.47.1-1 | 137 | 138 | 139 | 140 | 141 | 142 |
| 1.49.1-1 | 137 | 138 | 139 | 140 | 141 | 142 |
| 1.50.1-1 | 137 | 138 | 139 | 140 | 141 | 142 |
| 1.51.1-1 | 137 | 138 | 154 | 140 | 141 | 142 |
| 1.1.104-1 | 137 | 138 | 139 | 140 | 141 | 142 |
| 3-1 | 137 | 138 | 139 | 140 | 141 | 142 |
| 1.52.1-1 | 137 | 138 | 139 | 140 | 141 | 142 |
| 1.52.64-1 | 137 | 138 | 139 | 140 | 141 | 142 |
| 1.52.90 | 137 | 138 | 139 | 140 | 141 | 142 |
| 2.4.1-1 | 153 | 138 | 139 | 140 | 141 | 142 |

Table 13 provides the SEQ ID NOs of the VH, VL, heavy and light chains of the anti-gp120 antibodies disclosed herein.

TABLE 13

SEQ ID NOs of VH, VL, heavy chains (HC) and light chains (LC) of anti-gp120 antibodies

| Antibody Name | VH | VL | HC | LC |
|---|---|---|---|---|
| B | 181 | 222 | 1 | 48 |
| A-1 | 182 | 223 | 2 | 49 |
| A | 182 | 223 | 3 | 49 |
| C-1 | 183 | 224 | 4 | 50 |
| 1v2-1 | 184 | 223 | 5 | 49 |
| 1.2.1-1 | 185 | 223 | 6 | 49 |
| 1.1.2-1 | 182 | 225 | 2 | 50 |
| 1.2.2-1 | 185 | 225 | 6 | 50 |
| 1.3.1-1 | 186 | 223 | 7 | 49 |
| 1.4.1-1 | 187 | 223 | 8 | 49 |
| 1.5.1-1 | 188 | 223 | 9 | 49 |
| 1.6.1-1 | 189 | 223 | 10 | 49 |
| 1.7.1-1 | 190 | 223 | 11 | 49 |
| 1.8.1-1 | 191 | 223 | 12 | 49 |
| 1.9.1-1 | 192 | 223 | 13 | 49 |
| 1.10.1-1 | 193 | 223 | 14 | 49 |
| 1.11.1-1 | 194 | 223 | 15 | 49 |
| 1.15.1-1 | 195 | 223 | 16 | 49 |
| 1.16.1-1 | 196 | 223 | 17 | 49 |
| 1.17.1-1 | 197 | 223 | 18 | 49 |
| 1.18.1-1 | 198 | 223 | 19 | 49 |
| 1.19.1-1 | 199 | 223 | 20 | 49 |

TABLE 13-continued

SEQ ID NOs of VH, VL, heavy chains (HC) and light chains (LC) of anti-gp120 antibodies

| Antibody Name | VH | VL | HC | LC |
|---|---|---|---|---|
| 1.20.1-1 | 200 | 223 | 21 | 49 |
| 1.21.1-1 | 201 | 223 | 22 | 49 |
| 1.22.1-1 | 202 | 223 | 23 | 49 |
| 1.24.1-1 | 203 | 223 | 24 | 49 |
| 1.25.1-1 | 204 | 223 | 25 | 49 |
| 1.26.1-1 | 205 | 223 | 26 | 49 |
| 1.27.1-1 | 206 | 223 | 27 | 49 |
| 1.28.1-1 | 207 | 223 | 28 | 49 |
| 1.29.1-1 | 208 | 223 | 29 | 49 |
| 1.30.1-1 | 209 | 223 | 30 | 49 |
| 1.1.3-1 | 182 | 226 | 2 | 51 |
| 1.1.4-1 | 182 | 227 | 2 | 52 |
| 1.1.5-1 | 182 | 228 | 2 | 53 |
| 1.1.6-1 | 182 | 229 | 2 | 54 |
| 1.1.7-1 | 182 | 230 | 2 | 55 |
| 1.1.8-1 | 182 | 231 | 2 | 56 |
| 1.1.9-1 | 182 | 232 | 2 | 57 |
| 1.1.10-1 | 182 | 233 | 2 | 58 |
| 1.1.11-1 | 182 | 234 | 2 | 59 |
| 1.1.12-1 | 182 | 235 | 2 | 60 |
| 1.1.13-1 | 182 | 236 | 2 | 61 |
| 1.1.14-1 | 182 | 237 | 2 | 62 |
| 1.1.15-1 | 182 | 238 | 2 | 63 |
| 1.1.16-1 | 182 | 239 | 2 | 64 |
| 1.1.17-1 | 182 | 240 | 2 | 65 |
| 1.1.18-1 | 182 | 241 | 2 | 66 |

TABLE 13-continued

SEQ ID NOs of VH, VL, heavy chains (HC) and light chains (LC) of anti-gp120 antibodies

| Antibody Name | VH | VL | HC | LC |
|---|---|---|---|---|
| 1.1.19-1 | 182 | 242 | 2 | 67 |
| 1.1.20-1 | 182 | 243 | 2 | 68 |
| 1.1.21-1 | 182 | 244 | 2 | 69 |
| 1.1.22-1 | 182 | 245 | 2 | 70 |
| 1.1.23-1 | 182 | 246 | 2 | 71 |
| 1.1.24-1 | 182 | 247 | 2 | 72 |
| 1.1.25-1 | 182 | 248 | 2 | 73 |
| 1.1.26-1 | 182 | 249 | 2 | 74 |
| 1.1.27-1 | 182 | 250 | 2 | 75 |
| 1.1.28-1 | 182 | 251 | 2 | 76 |
| 1.1.29-1 | 182 | 252 | 2 | 77 |
| 1.1.30-1 | 182 | 253 | 2 | 78 |
| 1.12.15-1 | 210 | 238 | 31 | 63 |
| 1.13.15-1 | 211 | 238 | 32 | 63 |
| 1.14.15-1 | 212 | 238 | 33 | 63 |
| 1.12.17-1 | 210 | 240 | 31 | 65 |
| 1.13.17-1 | 211 | 240 | 32 | 65 |
| 1.14.17-1 | 212 | 240 | 33 | 65 |
| 1.31.1-1 | 213 | 223 | 34 | 49 |
| 1.32.1-1 | 214 | 223 | 35 | 49 |
| 1.33.1-1 | 215 | 223 | 36 | 49 |
| 1.34.1-1 | 216 | 223 | 37 | 49 |
| 1.35.1-1 | 217 | 223 | 38 | 49 |
| 1.36.1-1 | 218 | 223 | 39 | 49 |
| 1.1.31-1 | 182 | 254 | 2 | 79 |
| 1.31.31-1 | 213 | 254 | 34 | 79 |
| 1.32.31-1 | 214 | 254 | 35 | 79 |
| 1.33.31-1 | 215 | 254 | 36 | 79 |
| 1.34.31-1 | 216 | 254 | 37 | 79 |
| 1.35.31-1 | 217 | 254 | 38 | 79 |
| 1.36.31-1 | 218 | 254 | 39 | 79 |
| 1.1.32-1 | 182 | 255 | 2 | 80 |
| 1.31.32-1 | 213 | 255 | 34 | 80 |
| 1.32.32-1 | 214 | 255 | 35 | 80 |
| 1.33.32-1 | 215 | 255 | 36 | 80 |
| 1.34.32-1 | 216 | 255 | 37 | 80 |
| 1.35.32-1 | 217 | 255 | 38 | 80 |
| 1.36.32-1 | 218 | 255 | 39 | 80 |
| 1.1.33-1 | 182 | 256 | 2 | 81 |
| 1.31.33-1 | 213 | 256 | 34 | 81 |
| 1.32.33-1 | 214 | 256 | 35 | 81 |
| 1.33.33-1 | 215 | 256 | 36 | 81 |
| 1.34.33-1 | 216 | 256 | 37 | 81 |
| 1.35.33-1 | 217 | 256 | 38 | 81 |
| 1.36.33-1 | 218 | 256 | 39 | 81 |
| 1.1.34-1 | 182 | 257 | 2 | 82 |
| 1.31.34-1 | 213 | 257 | 34 | 82 |
| 1.32.34-1 | 214 | 257 | 35 | 82 |
| 1.33.34-1 | 215 | 257 | 36 | 82 |
| 1.34.34-1 | 216 | 257 | 37 | 82 |
| 1.35.34-1 | 217 | 257 | 38 | 82 |
| 1.36.34-1 | 218 | 257 | 39 | 82 |
| 1.1.35-1 | 182 | 258 | 2 | 83 |
| 1.31.35-1 | 213 | 258 | 34 | 83 |
| 1.32.35-1 | 214 | 258 | 35 | 83 |
| 1.33.35-1 | 215 | 258 | 36 | 83 |
| 1.34.35-1 | 216 | 258 | 37 | 83 |
| 1.35.35-1 | 217 | 258 | 38 | 83 |
| 1.36.35-1 | 218 | 258 | 39 | 83 |
| 1.1.36-1 | 182 | 259 | 2 | 84 |
| 1.31.36-1 | 213 | 259 | 34 | 84 |
| 1.32.36-1 | 214 | 259 | 35 | 84 |
| 1.33.36-1 | 215 | 259 | 36 | 84 |
| 1.34.36-1 | 216 | 259 | 37 | 84 |
| 1.35.36-1 | 217 | 259 | 38 | 84 |
| 1.36.36-1 | 218 | 259 | 39 | 84 |
| 1.1.37-1 | 182 | 260 | 2 | 85 |
| 1.1.38-1 | 182 | 261 | 2 | 86 |
| 1.1.39-1 | 182 | 262 | 2 | 87 |
| 1.1.40-1 | 182 | 263 | 2 | 88 |
| 1.1.41-1 | 182 | 264 | 2 | 89 |
| 1.1.42-1 | 182 | 265 | 2 | 90 |
| 1.1.43-1 | 182 | 266 | 2 | 91 |
| 1.1.44-1 | 182 | 267 | 2 | 92 |
| 1.1.45-1 | 182 | 268 | 2 | 93 |
| 1.1.46-1 | 182 | 269 | 2 | 94 |
| 1.1.47-1 | 182 | 270 | 2 | 95 |
| 1.1.48-1 | 182 | 271 | 2 | 96 |
| 1.1.49-1 | 182 | 272 | 2 | 97 |
| 1.37.51-1 | 219 | 273 | 40 | 98 |
| 1.8.52-1 | 191 | 274 | 12 | 99 |
| 1.1.54-1 | 182 | 275 | 2 | 100 |
| A-2 | 182 | 223 | 41 | 49 |
| B-1 | 220 | 276 | 42 | 101 |
| 2.1.2-1 | 220 | 277 | 42 | 102 |
| 1.1.64-1 | 182 | 278 | 2 | 103 |
| 1.1.67-1 | 182 | 279 | 2 | 104 |
| 1.1.72-1 | 182 | 280 | 2 | 105 |
| 1.1.75-1 | 182 | 281 | 2 | 106 |
| 1.1.78-1 | 182 | 282 | 2 | 107 |
| A-3 | 182 | 223 | 43 | 49 |
| A-4 | 182 | 223 | 44 | 49 |
| A-5 | 182 | 223 | 45 | 49 |
| A-6 | 182 | 223 | 46 | 49 |
| 1.41.5-1 | 221 | 228 | 47 | 53 |
| 1.41.81-1 | 221 | 283 | 47 | 108 |
| 1.1.82-1 | 182 | 284 | 2 | 109 |
| 1.41.83-1 | 221 | 285 | 47 | 110 |
| 1.1.84-1 | 182 | 286 | 2 | 111 |
| 1.41.85-1 | 221 | 287 | 47 | 112 |
| 1.41.86-1 | 221 | 288 | 47 | 113 |
| 1.41.87-1 | 221 | 289 | 47 | 114 |
| 1.1.88-1 | 182 | 290 | 2 | 115 |
| 1.41.89-1 | 221 | 291 | 47 | 116 |
| 1.1.90-1 | 182 | 292 | 2 | 117 |
| 1.41.91-1 | 221 | 293 | 47 | 118 |
| 1.41.92-1 | 221 | 294 | 47 | 119 |
| 1.41.93-1 | 221 | 295 | 47 | 120 |
| 1.1.94-1 | 182 | 296 | 2 | 121 |
| 1.41.95-1 | 221 | 297 | 47 | 122 |
| 1.1.96-1 | 182 | 298 | 2 | 123 |
| 1.41.97-1 | 221 | 299 | 47 | 124 |
| 1.41.98-1 | 221 | 300 | 47 | 125 |
| 1.41.99-1 | 221 | 301 | 47 | 126 |
| 1.1.100-1 | 182 | 302 | 2 | 127 |
| 1.41.101-1 | 221 | 303 | 47 | 128 |
| 1.1.102-1 | 182 | 304 | 2 | 129 |
| 1.41.103-1 | 221 | 305 | 47 | 130 |
| 1.1.110-1 | 182 | 306 | 2 | 131 |
| 1.1.111-1 | 182 | 307 | 2 | 132 |
| 1.1.112-1 | 182 | 308 | 2 | 133 |
| 1.1.113-1 | 182 | 309 | 2 | 134 |
| 2.1.3-1 | 220 | 310 | 42 | 135 |
| 2.1.4-1 | 220 | 311 | 42 | 136 |
| 2.2.1-1 | 465 | 276 | 517 | 101 |
| 2.3.1-1 | 466 | 276 | 518 | 101 |
| 3.1.8-1 | 182 | 479 | 2 | 531 |
| 2.2.8-1 | 465 | 479 | 517 | 531 |
| 2.3.8-1 | 466 | 479 | 518 | 531 |
| 3.1.9-1 | 182 | 480 | 2 | 532 |
| 2.2.9-1 | 465 | 480 | 517 | 532 |
| 2.3.9-1 | 466 | 480 | 518 | 532 |
| 1.1.115-1 | 182 | 481 | 2 | 533 |
| 3.1.10-1 | 182 | 482 | 2 | 534 |
| 2.2.10-1 | 465 | 482 | 517 | 534 |
| 2.3.10-1 | 466 | 482 | 518 | 534 |
| 1.1.116-1 | 182 | 483 | 2 | 535 |
| 3.1.11-1 | 182 | 484 | 2 | 536 |
| 2.2.11-1 | 465 | 484 | 517 | 536 |
| 2.3.11-1 | 466 | 484 | 518 | 536 |
| 1.1.117-1 | 182 | 485 | 2 | 537 |
| 3.1.12-1 | 182 | 486 | 2 | 538 |
| 2.2.12-1 | 465 | 486 | 517 | 538 |
| 2.3.12-1 | 466 | 486 | 518 | 538 |
| 1.1.118-1 | 182 | 487 | 2 | 539 |
| 3.1.13-1 | 182 | 488 | 2 | 540 |
| 2.2.13-1 | 465 | 488 | 517 | 540 |
| 2.3.13-1 | 466 | 488 | 518 | 540 |
| 3.1.14-1 | 182 | 489 | 2 | 541 |
| 2.2.14-1 | 465 | 489 | 517 | 541 |

TABLE 13-continued

SEQ ID NOs of VH, VL, heavy chains (HC) and light chains (LC) of anti-gp120 antibodies

| Antibody Name | VH | VL | HC | LC |
|---|---|---|---|---|
| 2.3.14-1 | 466 | 489 | 518 | 541 |
| 3.1.5-1 | 182 | 491 | 2 | 542 |
| 2.2.5-1 | 465 | 491 | 517 | 542 |
| 2.3.5-1 | 466 | 491 | 518 | 542 |
| 3.1.15-1 | 182 | 492 | 2 | 543 |
| 2.2.15-1 | 465 | 492 | 517 | 543 |
| 2.3.15-1 | 466 | 492 | 518 | 543 |
| 1.1.119-1 | 182 | 493 | 2 | 544 |
| 3.1.7-1 | 182 | 494 | 2 | 545 |
| 2.2.7-1 | 465 | 494 | 517 | 545 |
| 2.3.7-1 | 466 | 494 | 518 | 545 |
| 3.1.2-1 | 182 | 277 | 2 | 102 |
| 2.2.2-1 | 465 | 277 | 517 | 102 |
| 2.3.2-1 | 466 | 277 | 518 | 102 |
| 3.1.16-1 | 182 | 495 | 2 | 546 |
| 2.2.16-1 | 465 | 495 | 517 | 546 |
| 2.3.16-1 | 466 | 495 | 518 | 546 |
| 3.1.17-1 | 182 | 496 | 2 | 547 |
| 2.2.17-1 | 465 | 496 | 517 | 547 |
| 2.3.17-1 | 466 | 496 | 518 | 547 |
| 3.1.18-1 | 182 | 497 | 2 | 548 |
| 2.2.18-1 | 465 | 497 | 517 | 548 |
| 2.3.18-1 | 466 | 497 | 518 | 548 |
| 1.1.120-1 | 182 | 498 | 2 | 549 |
| 3.1.19-1 | 182 | 499 | 2 | 550 |
| 2.2.19-1 | 465 | 499 | 517 | 550 |
| 2.3.19-1 | 466 | 499 | 518 | 550 |
| 1.1.121-1 | 182 | 500 | 2 | 551 |
| 3.1.20-1 | 182 | 501 | 2 | 552 |
| 2.2.20-1 | 465 | 501 | 517 | 552 |
| 2.3.20-1 | 466 | 501 | 518 | 552 |
| 1.1.122-1 | 182 | 502 | 2 | 553 |
| 1.1.123-1 | 182 | 503 | 2 | 554 |
| 1.1.124-1 | 182 | 504 | 2 | 555 |
| 1.1.125-1 | 182 | 505 | 2 | 556 |
| 1.1.126-1 | 182 | 506 | 2 | 557 |
| 1.1.127-1 | 182 | 507 | 2 | 558 |
| 1.1.128-1 | 182 | 508 | 2 | 559 |
| 1.1.129-1 | 182 | 509 | 2 | 560 |
| 1.1.130-1 | 182 | 510 | 2 | 561 |
| 1.1.131-1 | 182 | 511 | 2 | 562 |
| 1.1.132-1 | 182 | 512 | 2 | 563 |
| 1.1.133-1 | 182 | 513 | 2 | 564 |
| 1.1.134-1 | 182 | 514 | 2 | 565 |
| 1.1.135-1 | 182 | 515 | 2 | 566 |
| 1.1.138-1 | 182 | 569 | 2 | 568 |
| 1.42.1-1 | 467 | 223 | 519 | 49 |
| 1.43.1-1 | 468 | 223 | 520 | 49 |
| 1.44.1-1 | 469 | 223 | 521 | 49 |
| 1.45.1-1 | 470 | 223 | 522 | 49 |
| 1.46.1-1 | 471 | 223 | 523 | 49 |
| 1.47.1-1 | 472 | 223 | 524 | 49 |
| 1.49.1-1 | 474 | 223 | 526 | 49 |
| 1.50.1-1 | 475 | 223 | 527 | 49 |
| 1.51.1-1 | 476 | 223 | 528 | 49 |
| 1.1.104-1 | 182 | 516 | 2 | 567 |
| 3-1 | 182 | 276 | 2 | 101 |
| 1.52.1-1 | 477 | 223 | 529 | 49 |
| 1.52.64-1 | 477 | 278 | 529 | 103 |
| 1.52.90 | 477 | 292 | 529 | 117 |
| 2.4.1-1 | 478 | 276 | 530 | 101 |

Example 3: Mass Spectrometry Analysis

Antibody A-1 was transiently expressed in EXPICHO™ cells and protein-A purified using standard methods. The sample was denatured and reduced by using 4 M guanidine hydrochloride and 50 mM DTT (final concentrations) and heating for 20 minutes at 60° C. The sample was desalted online as reduced heavy and light chains were separated on a BEH C4 reverse phase chromatography column prior to infusion into the source of a Waters Synapt G2Si hybrid time-of-flight mass spectrometer. Multiply-charged protein peak packets were deconvoluted used the Maximum Entropy deconvolution algorithm. Results show that the Antibody A light chain was glycosylated. The observed light chain mass spectrum reveals the presence of a G0-glycan modification with additional glycan-associated mass heterogeneity. This observation is consistent with the presence of an N72 consensus glycosylation motif in the Antibody A VL domain (NLT), and with previous crystal structures of Antibody A showing glycosylation at this position (Zhou et al., *Immunity*, 39:245-258 (2013); Klein et al., *Cell*, 153: 126-138 (2013)).

Example 4: Accelerated Stress-Induced Potency Loss

To identify chemical liabilities, an accelerated thermal stability study (stress panel) was performed for A-1. The antibody was stressed at pH 5.9 at 25° C. and 37° C. (formulation like stress) and at pH 7.4 at 37° C. (mock physiological-like stress). Samples were pulled and frozen at T0, in addition to 2, 4, and 6 weeks. Select samples were screened for stress-induced potency loss prior to implementation of other methods. The potency assay employed for the stressed A-1 samples was an ADCC reporter assay which uses a reporter cell that expresses luciferase when the FcγRIIIa receptors on its cell surface are tethered via a functional mAb's Fc and Fab domains to a target cell. The target cell in the assay expresses the HIV Env glycoprotein to which the A-1 Fab binds. Luciferase stoichiometrically converts excess luminescent substrate producing light measured in the assay. Response curves are indicative of antibody potency.

As shown in FIG. 1, the most significant potency losses for A-1 occurred in the pH 5.9 conditions. We next conducted peptide mapping on the stress panel to identify the stress-induced chemical modification leading to loss of activity at pH 5.9. We additionally conducted peptide maps on the pH 7.4 stressed samples to identify modifications that might be prone to occur under physiological-like conditions.

The antibody A-1 stress panel samples were denatured, reduced, and alkylated with iodoacetamide prior digestion with the endoproteinase Lys-C. Protein digests were subsequently analyzed by reverse phase LC-MS/MS on a Thermo Q-Exactive HF mass spectrometer. Peptide maps were analyzed using Thermo Pepfinder and Xcalibur softwares, while ion lists were further analyzed in Microsoft Excel. Since our ADCC reporter data suggested the most significant potency losses at the pH 5.9 conditions we searched the ion lists for modifications occurring over time but that were unique to the pH 5.9 conditions. The most significant stress-induced, time dependent modification unique to the pH 5.9 conditions was oxidation of tryptophan 76 in the mAb heavy chain observed on the peptide $T_{55}$GQPNNPRQFQGRVSLT-RHASWDFDTFSFYMDLK$_{88}$ (T55-K88) (SEQ ID NO: 630) as additions of oxygen (+15.99 Da) and further conversion to kynurenine (+3.99 Da). For relative quantification of these conversions the peak intensities from the Pepfinder ion list outputs for the two oxidized variants were summed and then compared to the sum of all modified and non-modified T55-K88 peptide peak intensities. The resultant summed oxidized peptide outputs for the various stress conditions are presented in FIG. 2. It was on the basis of these studies that we identified W74a (Kabat, FR3 insertion) oxidation as a potential risk to pharmaceutical stability of antibody A-1.

In addition to the significant oxidation at heavy chain W74a observed in pH 5.9 conditions, approximately 8-9% deamidation at light chain position N26 was observed on the constructs at T0 and increased further at pH 7.4 incubation conditions. The percentage of deamidation reported reflect the combination of asparagine deamidated to aspartic acid (+0.98 Da), isoaspartic acid (+0.98), and aspartyl succinimide (−17.03 Da) and were observed on light chain peptide (SEQ ID NO: 631)
$D_1$IQMTQSPSSLSASVGDTVTITCQANGYLNWYQQRRGK$_{38}$.

Figure 3:
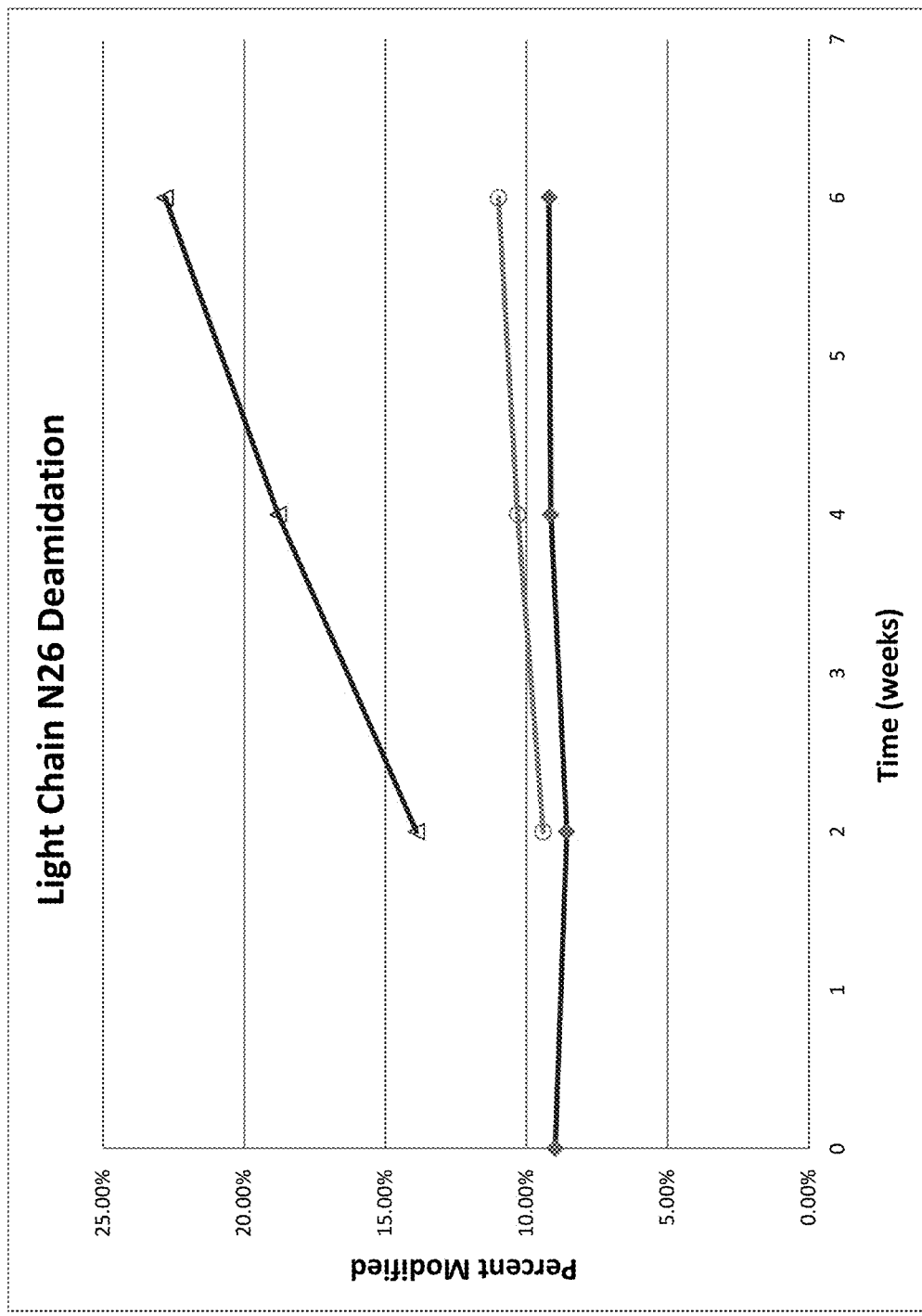
FIG. 3 illustrates kinetics of N26 deamidation over time as measured in the stress panel (include oxidation to aspartic acid, isoaspartic acid, and aspartyl succinimide intermediate). Diamond: Antibody A-1, 25° C., pH 5.9. Open circle: Antibody A-1, 37° C., pH 5.9. Open triangle: Antibody A-1, 37° C., pH 7.4. The degree of deamidation was greatest at the pH 7.4 sample stressed at 37° C. for 6 weeks.

The results are depicted in FIG. 3.

Although it is part of the antibody framework, heavy chain residue, W74a is found within in an usual framework insertion loop that forms part of the antibody paratope, and thus directly contacts the HIV gp120 (Lee et al. 2017. *Immunity* 46: 690-702). Light chain residue N26 is part of an NG deamidation risk motif in CDR1 that is formed by an unusual germline deletion in antibody A-1. Like W74a, N26 forms part of the paratope and is predicted to make contact with elements of HIV gp120. Based on available structural models, we next designed a panel of 15 mutants designed to remove the W74a oxidation site and the N26 deamidation motif. The mutations were screened in HIV neutralization assays (see, Example 10) to identify a variant that removed W74a, but had minimal impact on neutralization potency or breadth of antibody A-1.

Example 5: T-Cell Epitope Mapping

To assess the immunogenicity and identify immunodominant T-cell epitopes, the Antitope Epi-Screen T-cell Epitope Mapping Assay was used to screen overlapping 15-mer peptides covering the entire Antibody A LC and HC Fv sequence. The background donor response (n=50 donors) of the assay was 8%, and responses >10% would be considered as positive in this assay. The T-cell epitope mapping results on Antibody A HC and LC identified a single peptide, GDTVTITCQANGYLN (SEQ ID NO: 320), containing a putative T-cell epitope—with a donor response rate of 18% in the Antibody A light chain.

Computational prediction of the core 9 mer using the antitope iTope algorithm identified VTITCQANG (SEQ ID NO: 321) as the potential WWII binding 9 mer core within the peptide, with residue V19 being the P1 anchor position. The C-terminus of this epitope overlaps with non-germline residues in CDR L1 that are known to contact the gp120 antigen as observed in co-crystal structures. To avoid disrupting antigen binding via germline reversion of CDR L1 this epitope was removed by introducing the LC V19A mutation at the P1 anchor position.

Example 6: Antibody Characterization

Scanning and combinatorial mutagenesis were used to generate additional antibodies to assess the biophysical and functional impact of germline reversions and glycan removal on Antibody A. Single point ELISA assays at the $EC_{50}$ concentration for Antibody A-1 were conducted for each of three unique HIV gp120 antigens in 384 well format and normalized to plate controls. DSF assays were conducted in parallel to assess the impact of mutations on Fab melting temperature (Tm). The results are shown in Table 14.

TABLE 14

Antibody characterization by ELISA and DSF

| Antibody | ELISA gp120 Bal ($A_{450}$) | ELISA gp120 SHIV SF162 P3 ($A_{450}$) | ELISA gp120 CAAN ($A_{450}$) | ELISA BSA ($A_{450}$) | DSF Fab Tm (° C.) |
|---|---|---|---|---|---|
| A-1 | 0.91 | 0.94 | 1.06 | 0.06 | 79.69 |
| 1.2.2-1 | 0.91 | 0.97 | 0.80 | 0.06 | 79.65 |
| 1.2.1-1 | 0.93 | 1.02 | 1.01 | 0.07 | 79.35 |
| 1.3.1-1 | 0.97 | 1.13 | 0.94 | 0.06 | 77.85 |
| 1.4.1-1 | 1.04 | 1.19 | 0.96 | 0.06 | 78.90 |
| 1.5.1-1 | 0.92 | 1.15 | 1.07 | 0.06 | 82.02 |
| 1.6.1-1 | 0.95 | 1.10 | 0.90 | 0.06 | 78.27 |
| 1.7.1-1 | 0.98 | 1.08 | 1.04 | 0.06 | 79.56 |
| 1.8.1-1 | 0.86 | 0.94 | 0.90 | 0.06 | 78.77 |
| 1.9.1-1 | 1.08 | 1.23 | 0.98 | 0.06 | 82.40 |
| 1.10.1-1 | 0.95 | 1.03 | 0.94 | 0.06 | 78.23 |
| 1.11.1-1 | 0.93 | 0.57 | 0.75 | 0.09 | 71.14 |
| 1.15.1-1 | 0.87 | 1.24 | 1.38 | 0.06 | 71.14 |
| 1.16.1-1 | 0.92 | 0.90 | 0.87 | 0.07 | 72.77 |
| 1.17.1-1 | 0.84 | 0.31 | 0.70 | 0.06 | 71.27 |
| 1.18.1-1 | 0.97 | 1.36 | 1.18 | 0.07 | 71.39 |
| 1.19.1-1 | 0.85 | 0.96 | 0.93 | 0.06 | 80.03 |
| 1.20.1-1 | 0.89 | 0.91 | 0.80 | 0.06 | 77.78 |
| 1.21.1-1 | 0.87 | 0.82 | 0.77 | 0.07 | 78.28 |
| 1.22.1-1 | 1.03 | 0.78 | 0.87 | 0.06 | 77.15 |
| 1v2-1 | 1.03 | 1.29 | 1.00 | 0.08 | 79.28 |
| 1.24.1-1 | 0.98 | 1.09 | 0.90 | 0.06 | 75.02 |
| 1.25.1-1 | 1.07 | 1.03 | 1.16 | 0.06 | 77.16 |
| 1.26.1-1 | 0.81 | 0.94 | 1.00 | 0.06 | 78.54 |
| 1.27.1-1 | 0.86 | 0.86 | 0.86 | 0.07 | 75.28 |
| 1.28.1-1 | 1.05 | 0.99 | 0.99 | 0.06 | 76.03 |
| 1.29.1-1 | 1.03 | 0.98 | 1.08 | 0.06 | 80.04 |
| 1.30.1-1 | 0.81 | 1.03 | 1.05 | 0.06 | 79.17 |
| 1.1.2-1 | 0.95 | 1.01 | 0.93 | 0.06 | 78.54 |
| 1.1.3-1 | 0.97 | 0.97 | 1.00 | 0.07 | 79.29 |
| 1.1.4-1 | 0.96 | 1.07 | 1.09 | 0.06 | 79.42 |
| 1.1.5-1 | 0.90 | 0.93 | 0.90 | 0.06 | 78.41 |
| 1.1.6-1 | 0.91 | 0.41 | 0.46 | 0.07 | 78.92 |
| 1.1.7-1 | 0.95 | 1.02 | 1.00 | 0.06 | 78.89 |
| 1.1.8-1 | 1.01 | 0.37 | 0.50 | 0.06 | 79.40 |
| 1.1.9-1 | 0.98 | 1.09 | 0.93 | 0.07 | 77.81 |
| 1.1.10-1 | 0.94 | 1.02 | 1.10 | 0.06 | 78.89 |
| 1.1.11-1 | 0.92 | 0.93 | 1.03 | 0.06 | 78.64 |
| 1.1.12-1 | 1.05 | 1.13 | 1.02 | 0.06 | 78.52 |
| 1.1.13-1 | 0.94 | 0.97 | 1.11 | 0.06 | 78.77 |
| 1.1.14-1 | | Low Yield/No Expression | | | |
| 1.1.15-1 | 0.93 | 0.79 | 0.79 | 0.06 | 79.02 |
| 1.1.16-1 | 1.06 | 1.05 | 0.99 | 0.06 | 80.77 |
| 1.1.17-1 | 1.02 | 1.07 | 0.90 | 0.06 | 85.20 |
| 1.1.18-1 | 0.92 | 0.94 | 0.92 | 0.06 | 80.66 |
| 1.1.19-1 | 1.03 | 1.12 | 1.05 | 0.06 | 80.36 |
| 1.1.20-1 | 0.94 | 1.01 | 0.95 | 0.07 | 77.90 |
| 1.1.21-1 | 0.98 | 1.03 | 0.99 | 0.06 | 81.78 |
| 1.1.22-1 | 0.88 | 1.04 | 1.02 | 0.06 | 80.53 |
| 1.1.23-1 | 0.90 | 1.07 | 0.95 | 0.06 | 81.66 |
| 1.1.24-1 | 0.88 | 0.97 | 0.98 | 0.06 | 80.15 |
| 1.1.25-1 | 0.90 | 1.01 | 0.92 | 0.07 | 78.65 |
| 1.1.26-1 | 0.96 | 1.09 | 1.07 | 0.06 | 79.03 |
| 1.1.27-1 | 0.97 | 1.10 | 0.99 | 0.06 | 77.78 |
| 1.1.28-1 | 0.98 | 1.09 | 0.93 | 0.06 | 77.65 |
| 1.1.29-1 | 0.91 | 0.90 | 1.01 | 0.06 | 79.17 |
| 1.1.30-1 | 0.90 | 0.98 | 0.86 | 0.06 | 80.67 |
| 1.12.15-1 | 0.69 | 0.53 | 0.63 | 0.06 | 78.41 |
| 1.13.15-1 | 0.70 | 0.52 | 0.60 | 0.06 | 76.41 |
| 1.14.15-1 | | Low Yield/No Expression | | | |
| 1.12.17-1 | 0.90 | 0.75 | 0.84 | 0.06 | 82.67 |
| 1.13.17-1 | 1.02 | 0.69 | 0.78 | 0.06 | 79.04 |
| 1.14.17-1 | 0.89 | 0.24 | 0.43 | 0.10 | 73.15 |
| 1.31.1-1 | 0.82 | 0.87 | 0.92 | 0.06 | 79.67 |
| 1.32.1-1 | 0.93 | 0.91 | 0.83 | 0.06 | 75.03 |
| 1.33.1-1 | 0.88 | 0.96 | 0.98 | 0.06 | 83.28 |
| 1.34.1-1 | 0.83 | 0.79 | 0.90 | 0.07 | 79.15 |
| 1.35.1-1 | 0.84 | 0.80 | 0.87 | 0.07 | 75.77 |
| 1.36.1-1 | 1.13 | 0.59 | 0.75 | 0.18 | 69.63 |
| 1.1.31-1 | 0.87 | 0.87 | 0.96 | 0.06 | 78.64 |
| 1.31.31-1 | 0.98 | 0.97 | 1.02 | 0.07 | 79.15 |
| 1.32.31-1 | 0.95 | 0.66 | 0.90 | 0.07 | 75.01 |

TABLE 14-continued Antibody characterization by ELISA and DSF

| Antibody | ELISA gp120 Bal (A$_{450}$) | ELISA gp120 SHIV SF162 P3 (A$_{450}$) | ELISA gp120 CAAN (A$_{450}$) | ELISA BSA (A$_{450}$) | DSF Fab Tm (° C.) |
|---|---|---|---|---|---|
| 1.33.31-1 | 0.92 | 0.89 | 1.18 | 0.07 | 82.44 |
| 1.34.31-1 | 0.91 | 0.77 | 0.92 | 0.06 | 78.64 |
| 1.35.31-1 | 1.05 | 0.68 | 0.99 | 0.07 | 75.39 |
| 1.36.31-1 | Low Yield/No Expression | | | | |
| 1.1.32-1 | 0.93 | 0.89 | 1.04 | 0.06 | 81.07 |
| 1.31.32-1 | 0.98 | 0.91 | 1.04 | 0.06 | 81.40 |
| 1.32.32-1 | 0.89 | 0.70 | 0.90 | 0.08 | 77.52 |
| 1.33.32-1 | 0.98 | 0.98 | 1.13 | 0.07 | 85.42 |
| 1.34.32-1 | 0.93 | 0.69 | 0.97 | 0.06 | 81.78 |
| 1.35.32-1 | 0.96 | 0.58 | 1.01 | 0.06 | 77.27 |
| 1.36.32-1 | 0.96 | 0.18 | 0.50 | 0.07 | 71.26 |
| 1.1.33-1 | 0.87 | 0.84 | 0.94 | 0.07 | 78.40 |
| 1.31.33-1 | 0.89 | 0.74 | 0.86 | 0.06 | 78.27 |
| 1.32.33-1 | 0.93 | 0.71 | 0.68 | 0.06 | 74.27 |
| 1.33.33-1 | 1.09 | 0.97 | 1.06 | 0.07 | 81.78 |
| 1.34.33-1 | 1.10 | 0.82 | 1.04 | 0.06 | 77.15 |
| 1.35.33-1 | 0.90 | 0.65 | 0.91 | 0.06 | 74.64 |
| 1.36.33-1 | Low Yield/No Expression | | | | |
| 1.1.34-1 | 0.90 | 0.83 | 0.96 | 0.06 | 79.02 |
| 1.31.34-1 | 0.76 | 0.82 | 0.86 | 0.06 | 79.27 |
| 1.32.34-1 | 0.81 | 0.71 | 0.86 | 0.06 | 77.15 |
| 1.33.34-1 | 0.95 | 0.82 | 0.95 | 0.06 | 82.66 |
| 1.34.34-1 | 0.89 | 0.70 | 0.88 | 0.06 | 80.03 |
| 1.35.34-1 | 1.00 | 0.58 | 0.85 | 0.06 | 77.27 |
| 1.36.34-1 | 1.01 | 0.15 | 0.43 | 0.07 | 71.01 |
| 1.1.35-1 | 0.96 | 0.72 | 0.75 | 0.08 | 77.65 |
| 1.31.35-1 | 0.90 | 0.61 | 0.77 | 0.06 | 78.14 |
| 1.32.35-1 | 0.89 | 0.50 | 0.59 | 0.06 | 74.46 |
| 1.33.35-1 | 1.03 | 0.71 | 0.81 | 0.07 | 82.03 |
| 1.34.35-1 | 0.94 | 0.56 | 0.77 | 0.06 | 78.02 |
| 1.35.35-1 | 0.88 | 0.42 | 0.67 | 0.06 | 74.51 |
| 1.36.35-1 | 0.89 | 0.16 | 0.36 | 0.06 | 66.88 |
| 1.1.36-1 | 0.93 | 0.72 | 0.88 | 0.06 | 79.02 |
| 1.31.36-1 | 1.06 | 0.93 | 0.90 | 0.06 | 79.40 |
| 1.32.36-1 | 0.92 | 0.62 | 0.64 | 0.06 | 75.51 |
| 1.33.36-1 | 0.94 | 0.88 | 0.82 | 0.06 | 83.15 |
| 1.34.36-1 | 0.94 | 0.77 | 0.71 | 0.07 | 77.69 |
| 1.35.36-1 | 0.85 | 0.56 | 0.67 | 0.06 | 75.39 |
| 1.36.36-1 | 1.12 | 0.14 | 0.34 | 0.06 | 68.38 |

The results indicated that some germline reversions and combinatorial modifications affected gp120 binding and/or Fv thermal stability. Based on these data, multiple rounds of engineering were conducted. The V19A mutation (which may remove the predicted T-cell epitope shown above) and mutations made at light chain position N72 (Kabat numbering) (which may remove the N72-linked Fv glycan) were combined with other mutations in order to identify an antibody with improved functional and biophysical properties. The resulting antibodies were characterized by expression titer analysis, polyspecificity analysis, and/or HIV neutralization assays.

Example 7: Expression Titer Analysis of Antibodies without the Glycosylation Motif When expressing and purifying protein for the ELISA and DSF screening campaign, reduced expression titer was observed for antibodies lacking the glycosylation motif. Further mutations were generated to identify antibodies with improved protein expression.

The antibodies were expressed in EXPI293F™ cells using EXPIFECTAMINE™293 expression system following manufacturer's protocol (ThermoFisher Scientific, MA). Transfection was carried out in 30 ml scale in 50 ml SEPTAVENT™ disposable transfection tubes (Optimum Processing, CA). Briefly, 30 μg is total of heavy and light chain (ratio of HC:LC is 2:3) expressing plasmids were used per transfection. Diluted DNA in OPTI-MEM® reduced serum media was added to diluted EXPIFECTAMINE™293 reagent to allow complex formation. After 20 minutes incubation at room temperature, the reagent DNA complex was added to 28 mL of cells seeded at 2.5 million/mL. Culture was incubated at 37° C. in 8% CO$_2$ with shaking at 250 rpm for four days. Clarified supernatant was harvested by centrifugation at 500×g for 15 mins. Antibodies were purified by Hamilton STAR Liquid handler (Hamilton, Nev.) using Phytips (PhyNexus, CA) pre-packed with 1604, MABSELECT™ SURE™ antibody purification resin (GE Healthcare, NJ). Each of the 30 mL transfected volume was purified using 3 Phytips. After capture of the antibody, the resin was washed with 1×PBS prior to elution with 100 mM NaAcetate pH3.5. The eluted sample was neutralized with 1/10th volume of 1M Tris pH8.0. Samples were stored at 4° C. overnight. The elution plate was centrifuged at 1000×g for 10 minutes to remove precipitate if any. Concentration of the clarified elution was determined by measuring its absorbance at A280. Titer of each of the antibodies is expressed as follows (mg/L): [concentration (mg/mL)×volume of elution (mL)*1000]/30 mL. Glycosylation site mutations and expression titer are summarized in Table 15.

TABLE 15

Glycosylation site mutations and expression titer

| Antibody | Titer (mg/L) |
|---|---|
| A-1 | 243 |
| 1.1.10-1 | 148 |
| 1.1.37-1 | 104 |
| 1.1.38-1 | 113 |
| 1.1.39-1 | 93 |
| 1.1.40-1 | 133 |
| 1.1.41-1 | 104 |
| 1.1.42-1 | 158 |
| 1.1.43-1 | 124 |
| 1.1.44-1 | 70 |
| 1.1.45-1 | 77 |
| 1.1.46-1 | 136 |
| 1.1.47-1 | 45 |
| 1.1.48-1 | 65 |
| 1.1.49-1 | 27 |

The results in Table 15 show that all antibodies lacking the "NLT" glycosylation consensus motif exhibited reduced expression titer. This suggests that removal of the N72-linked glycan may have a negative effect on protein expression. The results also show that the L73F germline reversion, systematically reduces expression titer. Among the mutations tested, N72H, N72T and T74K had the highest expression titer and were carried forward for further analysis.

Example 8: Mammalian Display

To identify mutations that eliminate the Fab glycan while maintaining binding to HIV Env, improve expression titer, and/or reduce polyspecificity, a combinatorial light chain mutation library was designed and constructed using a set of trimer oligos (GenScript) varied at 6 sites, including R65, W67, E70, N72, L73, and T74. The synthesized light chain library harboring ~18,000 antibodies was sub-cloned into a modified pcDNA5/FRT vector (Invitrogen), containing the Antibody A heavy chain fused with a human PDGFR transmembrane domain at the C-terminus.

To display the antibodies in stably transfected cells, the constructed expression vector was co-transfected with pOG44 to Flp-In-CHO cells following the manufacturer's instructions (R758-07, Invitrogen). The transfected cells were selected and then maintained in hygromycin supplemented culture media. Antibody display and binding to HIV Env were analyzed by FACS following anti-human IgG (Fcγ specific) and HIV BG505.SOSSIP Virol., 89(10):5318-29 (2015)) staining. Cells collected after FACS sorting were expanded for DNA extraction and subsequent PCR-sequencing analysis to identify recovered mutations. More than one hundred clones were picked for sequencing before and after FACS sorting. The sequences recovered from two consecutive rounds of FACS sorts were next examined.

Results showed that antibodies with a sequence of TRRGQQYNLT (SEQ ID NO: 332), RRWGQNYNFT (SEQ ID NO: 333), TRRGQDYIFS (SEQ ID NO: 334), RRRGQDYILA (SEQ ID NO: 335), RRRGQNYTFT (SEQ ID NO: 336), RRFGQDYILT (SEQ ID NO: 337), TRFGQNYSLQ (SEQ ID NO: 338), or TRRGQNYTLA (SEQ ID NO: 339), TRRGQQYTLP (SEQ ID NO: 340), TRRGQDYILA (SEQ ID NO: 341), or SRFGQKYQLS (SEQ ID NO: 342) in the LC FR3 region had desirable expression levels and retain binding affinity to HIV BG505.SOSSIP. The mutations in SEQ ID NO:334, SEQ ID NO:337 and SEQ ID NO: 342 were incorporated into Antibodies 1.1.110-1, 1.1.111-1, 1.1.113-1, 2.1.3-1, 2.1.4-1 and 1.1.112-1.

Example 9: Polyspecificity Assessment

Polyspecificity of therapeutic antibodies may adversely affect pharmacokinetic properties and present potential safety concerns. It has been shown that Antibody A was polyreactive to double-stranded DNA and lipopolysaccharide in a four-antigen panel ELISA assay (Science, 333 (6049):1633-1637 (2011)). The polyspecificity risk of antibodies evaluated herein were tested in multiple assays including anti-nuclear antibody (Genes Immun., 13(5): 399-410 (2012)), anti-cardiolipin (Hum Antibodies, 14(3-4): 59-67 (2005)), anti-baculoviral particle ELISA (Proc. Natl. Acad. Sci. USA, 114(5):944-949 (2017)), and FACS-based HEK-293 and HEp2 cell binding assays (J. Virol., 88(21): 12669-82 (2014)). To compare polyspecificity, Antibody C and Antibody D, two polyspecific bNAbs (J. Virol., 88(21): 12669-82 (2014)), were used as positive controls; and a clinical sample of Rituximab (Myoderm Medical Supply) was used as a benchmark for low risk of polyspecificity. The tested articles were diluted to 1 μM in ELISA assays, and $OD_{450}$ values were normalized to control (no antibody) to calculate fold change. In cell binding assays, HEK293 or HEp2 cells were permeabilized and then incubated with serially diluted tested articles. The stained samples were FACS analyzed, and MFI (mean fluorescence intensity) was normalized to anti-human IgG-Fcγ secondary antibody only stained control. The relative binding signals were plotted against antibody concentrations, and fitted to non-linear response curve. Non-specific cell binding of each tested antibody was represented by binding AUC (area under curve).

Three single mutants with the N72 glycan removed (via point mutagenesis) show the highest expression titer (Table 5). In order to evaluate their contributions to A-1 polyspecificity, the mutants were tested in anti-nuclear antibody (ANA) and anti-cardiolipin ELISA assays as described above. The results of two independent assays are shown in Table 16. These results suggest that removal of the N72 glycan may lead to increases in polyspecificity. Among mutations tested, the N72T and N72H mutation show the lowest polyspecificity scores.

TABLE 16

Polyspecificity Assessment

| mAb (1 μM) | ANA (Normalized $OD_{450}$) | | Anti-Cardiolipin (Normalized $OD_{450}$) | |
|---|---|---|---|---|
| C | 24.5 | 26.5 | 15.6 | 17.2 |
| A-1 | 2.3 | 2.6 | 1.6 | 1.5 |
| 1.1.10-1 | 8.3 | 8.2 | 2.5 | 2.2 |
| 1.1.42-1 | 4.0 | 3.7 | 2.3 | 2.0 |
| 1.1.46-1 | 11.8 | 10.1 | 4.4 | 3.7 |
| Rituximab | 1.5 | | 1.3 | |

Antibodies with N72T, V19A and other mutations selected based on the functional analysis presented in Table 14 and Table 23 were tested in ANA and anti-cardiolipin ELISA assays for polyspecificity assessment. The results of these analyses are shown in Table 17.

TABLE 17

Polyspecificity Assessment of antibodies with N72T Mutation

| mAb (1 μM) | ANA (Normalized $OD_{450}$) | Anti-Cardiolipin (Normalized $OD_{450}$) |
|---|---|---|
| A | 1.9 | 1.2 |
| A-1 | 2.7 | 1.4 |
| 1.1.10-1 | 5.7 | 1.7 |
| 1.33.32-1 | 4.9 | 7.7 |
| 1.1.54-1 | 3.0 | 1.6 |
| 1.37.51-1 | 4.0 | 6.2 |
| 1.8.52-1 | 5.6 | 1.7 |
| C | 22.5 | 4.4 |
| D-1 | 14.6 | 7.7 |
| Rituximab | 1.3 | 1.0 |

The results in Table 17 show that all antibodies lacking the N72 glycan exhibited increased polyspecificity compared to Antibody A-1. Antibody 1.1.54, which contains the N72T and the V19A mutation, exhibited reduced polyspecificity compared to Antibody 1.1.10, which contained the N72T mutation alone. This suggests that the V19A mutation, which was introduced to remove a T-cell epitope, may have unexpected benefits in reducing the polyspecificity of the antibodies disclosed herein.

In order to identify antibodies with decreased polyspecificity, a 32-member combinatorial panel comprised of 5 sets of mutations to Antibody A-1 (Table 18) was tested in ANA, anti-cardiolipin ELISA, HEK293 and HEp2 binding assays as described above.

TABLE 18

Mutations Used to Generate a 32 Member Combinatorial Library

| Mutation Set | HC mutations | LC mutations |
|---|---|---|
| Set 1 | None | V19A |
| Set 2 | None | N72H |
| Set 3 | None | V98F, V99G |

TABLE 18-continued

Mutations Used to Generate a 32 Member Combinatorial Library

| Mutation Set | HC mutations | LC mutations |
|---|---|---|
| Set 4 | None | T18R, R65S, N76S, N77S |
| Set 5 | L5V, A10E, T12K, E23K, S105Q, Q108M | R39K, R40P |

The results of the assays were summarized and compared using polyspecificity scores (P-scores) that were calculated as ratio of each tested antibody to rituximab in each assay (Table 19). The average P-score values were used to rank the risk of polyspecificity of the tested antibodies. To statistically analyze the contribution of each mutation in the combinatorial dataset, pairwise comparisons were done for each combinatorial antibody in the presence or absence of the mutation sets listed in Table 19. In the context of the 32 member combinatorial antibody panel tested herein, 16 independent comparisons were conducted for each of the five mutation sets tested.

For each of the 16 pairwise combinations, the average P-score across the seven assays shown in Table 19 was compared using a paired T-test. The results showed an increase in polyspecificity due to introduction of the light chain N72H mutation as well as due to the introduction of the Set 5 mutations. The results showed a decrease in polyspecificity due to introduction of the light chain V19A or the V98F+V99G mutations. A modest but not statistically significant decrease in polyspecificity was observed upon introduction of the Set 4 mutations. Consistent with this statistical analysis, the antibody with the lowest average polyspecificity score was Antibody 1.1.90, which incorporated the V19A mutation, the V98F+V99G mutations, and the Set 4 mutations.

Antibodies A-1 and B-1 were next compared in polyspecificity assays. Additionally, antibodies with the following mutations were tested in various combinations: N72T, N72H, V19A, V98F+V99G, the Set 4 mutations, or the mutations identified in SEQ ID NO: 37. The antibodies were tested in baculoviral particle (BVP) ELISA and the results are summarized in Table 20. Test articles were assayed at 1

TABLE 19

Polyspecificity Scores (P-score) of Combinatorial Antibodies

| mAb | ANA | Anti-Cardiolipin | | HEK293 Binding | HEp2 Binding | | Mean | stdev |
|---|---|---|---|---|---|---|---|---|
| A-1 | 2.8 | 3.2 | 1.3 | 1.5 | 3.7 | 2.2 | 3.5 | 2.6 | 1 |
| 1.1.17-1 | 1.8 | 1.8 | 1.2 | 1.1 | 2.5 | 1.6 | 2.7 | 1.8 | 0.5 |
| 1.1.42-1 | n/a | 4.3 | n/a | 1.9 | 6 | n/a | 5 | 4.3 | 1.5 |
| 1.1.64-1 | 2 | 1.9 | 1.2 | 1.1 | 2.4 | 1.6 | 2.5 | 1.8 | 0.5 |
| 1.1.67-1 | 2.3 | 2.5 | 1.2 | 1.4 | 2.8 | 1.9 | 2.6 | 2.1 | 0.6 |
| 1.1.72-1 | n/a | 4.7 | n/a | 1.4 | 4 | n/a | 3.9 | 3.5 | 1.2 |
| 1.1.75-1 | 3.2 | 3.3 | 1.7 | 1.7 | 3.8 | 2.3 | 4.4 | 2.9 | 1 |
| 1.1.78-1 | 3.4 | 3.5 | 1.8 | 1.4 | 2.9 | 2.6 | 3.4 | 2.7 | 0.8 |
| 1.41.5-1 | n/a | 5 | n/a | 3.7 | 7.2 | n/a | 4.9 | 5.2 | 1.3 |
| 1.41.81-1 | 4.3 | 4.5 | 2.7 | 3.4 | 6.1 | 2 | 4.6 | 3.9 | 1.3 |
| 1.1.82-1 | 3 | 2.9 | 1.2 | 1.2 | 3.7 | 1.6 | 2.9 | 2.4 | 0.9 |
| 1.41.83-1 | 4.2 | 4.5 | 4.1 | 5.3 | 4.9 | 2.1 | 3.9 | 4.1 | 0.9 |
| 1.1.84-1 | 2.2 | 2.4 | 1.3 | 1.2 | 2.3 | 1.7 | 2 | 1.9 | 0.5 |
| 1.41.85-1 | 3.3 | 3.5 | 3.3 | 3.2 | 3.7 | 1.6 | 3.2 | 3.1 | 0.6 |
| 1.41.86-1 | 5.1 | 6.2 | 3 | 3.8 | 4.1 | 1.8 | 4 | 4 | 1.3 |
| 1.41.87-1 | 3.3 | 3.4 | 3.5 | 3.7 | 3.2 | 1.9 | 2.9 | 3.1 | 0.6 |
| 1.1.88-1 | 1.6 | 1.8 | 1.2 | 1.2 | 3.7 | 1.5 | 2.4 | 1.9 | 0.8 |
| 1.41.89-1 | 1.9 | 1.9 | 1.9 | 2.2 | 6.3 | 1.7 | 4.4 | 2.9 | 1.6 |
| 1.1.90-1 | 1.5 | 1.2 | 1.2 | 0.9 | 3.7 | 1 | 2.3 | 1.7 | 0.9 |
| 1.41.91-1 | 2.9 | 3.1 | 3.6 | 6.2 | 2.5 | 2.1 | 2.9 | 3.3 | 1.2 |
| 1.41.92-1 | n/a | 15.7 | n/a | 11.2 | 5.8 | n/a | 5.4 | 9.5 | 4.2 |
| 1.41.93-1 | n/a | 9.5 | n/a | 9.8 | 5.1 | n/a | 5.4 | 7.4 | 2.2 |
| 1.1.94-1 | 6.2 | 7.7 | 4.7 | 4.9 | 3.4 | 3.2 | 3.3 | 4.8 | 1.6 |
| 1.41.95-1 | 10.2 | 14.8 | 8.9 | 9.2 | 6.5 | 3.8 | 5.4 | 8.4 | 3.4 |
| 1.1.96-1 | 4.7 | 6.1 | 2.4 | 2.7 | 2.4 | 2.8 | 2.8 | 3.4 | 1.3 |
| 1.41.97-1 | 5.4 | 6.5 | 5.4 | 7.3 | 4.5 | 3.9 | 4.1 | 5.3 | 1.2 |
| 1.41.98-1 | 5.9 | 8 | 4.6 | 5.9 | 3.9 | 3.3 | 4 | 5.1 | 1.5 |
| 1.41.99-1 | 6.4 | 6.9 | 6.1 | 9.2 | 7.8 | 3.2 | 4.6 | 6.3 | 1.9 |
| 1.1.100-1 | 4.6 | 4.2 | 2 | 2.1 | 4.7 | 1.7 | 2.7 | 3.1 | 1.2 |
| 1.41.101-1 | 5.6 | 7.2 | 5.5 | 6.8 | 8.7 | 3.2 | 4.8 | 6 | 1.7 |
| 1.1.102-1 | 3.3 | 4 | 1.8 | 1.7 | 4.5 | 2.8 | 2.6 | 3 | 1 |
| 1.41.103-1 | 3.6 | 4.6 | 5.9 | 5.3 | 6.8 | 4.4 | 4 | 5 | 1 |
| C | 17.6 | 14.7 | 3.8 | 8.3 | 13.1 | 8.6 | 6.9 | 10.4 | 4.5 |
| D-1 | 8.7 | 10.4 | 1.9 | 3.3 | 7.3 | 7.1 | 4 | 6.1 | 2.8 |
| Rituximab | 1 | 1 | 1 | 1 | 1 | 1 | 1.1 | 1 | 0 |

µM concentration in duplicate in each experiment and the BVP score was calculated as a ratio of $OD_{450}$ to no mAb background.

TABLE 20

BVP Scores

| mAb | mean | SD | n |
|---|---|---|---|
| A | 10.9 | 1.1 | 2 |
| A-1 | 9.4 | 0.7 | 6 |
| 1.1.10-1 | 13.9 | n/a | 1 |
| 1.1.42-1 | 9.7 | 1.1 | 2 |
| 1.1.111-1 | 22.1 | 2.0 | 4 |
| 1.1.113-1 | 11.9 | n/a | 1 |
| 1.1.90-1 | 2.5 | 0.6 | 2 |
| B-1 | 2.7 | 0.9 | 3 |
| 2.1.2-1 | 47.1 | n/a | 1 |
| 2.1.3-1 | 8.2 | n/a | 1 |
| 2.1.4-1 | 7.7 | n/a | 1 |
| D-1 | 29.2 | 9.7 | 4 |
| C | 44.2 | 10.2 | 4 |
| Rituximab | 4.0 | 0.5 | 4 |

The results in Table 20 show that Antibody B-1 exhibited reduced polyspecificity compared to Antibody A-1. Like Antibody A, removal of the N72 glycan using the N72H mutation in Antibody 1.1.42 or Antibody 2.1.2 resulted in an increase in polyspecificity. Incorporation of the mutations discovered via mammalian display into Antibody 1.1.111 may increase polyspecificity, while incorporation of the same mutations into Antibody 2.1.3 may reduce polyspecificity compared to the N72H mutation. Adding the V19A mutation (e.g. Antibody 1.1.113 or Antibody 2.1.4) may systematically lower the polyspecificity in both cases.

An additional panel of 96 antibodies was generated to identify antibodies with improved neutralization breadth and potency, and ideally lacking the N72 linked glycan. This panel tested the effects of the set 1, 3 and 4 mutations (Table 18) as well as various N72 mutations and mutations derived from mammalian display in the context of antibody variable domains derived from Antibody A or combining elements of both Antibody A and Antibody B. The library also included a scanning mutagenesis campaign, where each amino acid differing between Antibody A and Antibody B was tested individually in the context of Antibody A. The panel was produced using high throughput methods and assayed using a high throughput BVP ELISA normalized for variations in sample concentration. The results of this assay are shown in Table 21.

TABLE 21

BVP Scores

| mAb | Normalized BVP Score |
|---|---|
| A-1 | 5.5 |
| 3-1 | 3.7 |
| 2.2.1-1 | 5.5 |
| 2.3.1-1 | 3.5 |
| 1.1.64-1 | 7.2 |
| 3.1.8-1 | 3.8 |
| 2.2.8-1 | 13.7 |
| 2.3.8-1 | 10.8 |
| 1.1.67-1 | 5.0 |
| 3.1.9-1 | 8.2 |
| 2.2.9-1 | 15.7 |
| 2.3.9-1 | 9.0 |
| 1.1.115-1 | 15.0 |
| 3.1.10-1 | 6.0 |
| 2.2.10-1 | 25.8 |

TABLE 21-continued

BVP Scores

| mAb | Normalized BVP Score |
|---|---|
| 2.3.10-1 | 13.6 |
| 1.1.116-1 | 27.1 |
| 3.1.11-1 | 14.6 |
| 2.2.11-1 | 34.4 |
| 2.3.11-1 | 19.1 |
| 1.1.117-1 | 18.7 |
| 3.1.12-1 | 15.2 |
| 2.2.12-1 | 35.7 |
| 2.3.12-1 | 24.3 |
| 1.1.118-1 | 13.1 |
| 3.1.13-1 | 19.4 |
| 2.2.13-1 | 15.2 |
| 2.3.13-1 | 12.5 |
| 1.1.10-1 | 10.8 |
| 3.1.14-1 | 12.5 |
| 2.2.14-1 | 26.4 |
| 2.3.14-1 | 6.0 |
| 1.1.54-1 | 8.3 |
| 3.1.5-1 | 7.0 |
| 2.2.5-1 | 13.2 |
| 2.3.5-1 | 6.3 |
| 1.1.104-1 | 7.8 |
| 3.1.15-1 | 8.1 |
| 2.2.15-1 | 25.3 |
| 2.3.15-1 | 12.2 |
| 1.1.119-1 | 12.9 |
| 3.1.7-1 | 8.4 |
| 2.2.7-1 | 15.5 |
| 2.3.7-1 | 9.1 |
| 1.1.42-1 | 7.7 |
| 3.1.2-1 | 7.4 |
| 2.2.2-1 | 26.0 |
| 2.3.2-1 | 11.3 |
| 1.1.75-1 | 14.6 |
| 3.1.16-1 | 13.4 |
| 2.2.16-1 | 33.9 |
| 2.3.16-1 | 18.0 |
| 1.1.78-1 | 10.4 |
| 3.1.17-1 | 14.4 |
| 2.2.17-1 | 39.6 |
| 2.3.17-1 | 25.6 |
| 1.1.102-1 | 7.4 |
| 3.1.18-1 | 11.9 |
| 2.2.18-1 | 26.5 |
| 2.3.18-1 | 15.4 |
| 1.1.120-1 | 14.2 |
| 3.1.19-1 | 14.1 |
| 2.2.19-1 | 32.1 |
| 2.3.19-1 | 24.4 |
| 1.1.121-1 | 8.4 |
| 3.1.20-1 | 6.7 |
| 2.2.20-1 | 22.7 |
| 2.3.20-1 | 13.2 |
| 1.1.122-1 | 12.5 |
| 1.1.123-1 | 10.0 |
| 1.1.124-1 | 8.9 |
| 1.1.125-1 | 8.6 |
| 1.1.126-1 | 9.8 |
| 1.1.127-1 | 13.9 |
| 1.1.128-1 | 12.0 |
| 1.1.129-1 | 16.8 |
| 1.1.130-1 | 13.8 |
| 1.1.131-1 | 8.3 |
| 1.1.111-1 | 17.1 |
| B-1 | 7.0 |
| 1.1.90-1 | 7.2 |
| 1.1.132-1 | 12.3 |
| 1.1.133-1 | 12.1 |
| 1.1.134-1 | 7.1 |
| 1.1.135-1 | 11.3 |
| 1.42.1-1 | 13.9 |
| 1.43.1-1 | 12.6 |
| 1.44.1-1 | 22.2 |
| 1.45.1-1 | 1.8 |
| 1.46.1-1 | 10.0 |
| 1.47.1-1 | 8.8 |

TABLE 21-continued

| BVP Scores | |
|---|---|
| mAb | Normalized BVP Score |
| 1.49.1-1 | 11.9 |
| 1.50.1-1 | 8.0 |
| 1.51.1-1 | 8.1 |
| A-1 | 8.1 |

The results for two separate production runs of Antibody A-1, shown in the first and last rows of Table 21, had BVP scores between 5.5 and 8.1. Antibodies incorporating mutations at N72 had systematically higher BVP scores, which was consistent with the above results demonstrating that removing the N72 linked glycan may lead to increased polyspecificity. Selected antibodies lacking N72 and incorporating the Antibody B light chain or heavy chains (or mutants derived from these chains), such as Antibodies 3.1.10-1, 2.3.14-1, 1.1.54-1, 3.1.5-1, and 2.3.5-1, did not show increased BVP ELISA scores compared to Antibody A-1.

An additional panel of 12 antibodies with N72 linked glycan or lacking the glycan was produced to further evaluate the role of the glycan in polyspecificity. Some antibodies were produced in both EXPI293™ and CHO-S cells. Mutations that may decrease polyspecificity, identified in the above assays, were incorporated into this panel. The results of this assay are shown in Table 22. Antibodies retaining the light chain N72 linked glycosylation motif had relatively lower BVP scores than antibodies lacking the N72 linked glycosylation motif.

TABLE 22

| BVP Scores. N >= 3 for each antibody | | | |
|---|---|---|---|
| N72 linked glycan | Name | Cell line | BVP Score |
| Yes | A-1 | Expi293 | 2.2 |
| | | CHO-S | 7.7 |
| | 1.1.64-1 | Expi293 | 2.0 |
| | | CHO-S | 6.6 |
| | 1.52.64-1 | Expi293 | 2.4 |
| | | CHO-S | 2.6 |
| | 1.1.90-1 | Expi293 | 1.7 |
| | 2.2.101 | Expi293 | 12.8 |
| | 2.4.1-1 | Expi293 | 5.2 |
| | 2.3.1-1 | Expi293 | 5.3 |
| No | 1.1.104-1 | ExpiCHO | 8.8 |
| | 1.1.119-1 | ExpiCHO | 6.0 |
| | 3.1.5-1 | ExpiCHO | 3.3 |
| | | CHO-S | 12.0 |
| | 2.2.5-1 | Expi293 | 32.5 |
| | 2.3.5-1 | Expi293 | 3.6 |

Example 10: HIV Neutralization Assay

To assess the breadth of antigen recognition for antibodies, HIV neutralization assays were conducted using a variety of virus isolates and clones. HIV neutralization potency (expressed as IC50 in µg/mL) of the antibodies were measured in the CEM-NKr-CCR5-Luc reporter cell based assay (Trkola et al., (1999), J. Virol., 73(11):8966-74) against a panel of replication competent subtype B viruses that included isolates and clones amplified from patient plasma samples (NIH AIDS Reagent Program) and the lab adapted stain HIV-1 BaL.

TABLE 23

| HIV Neutralization Potency | | | | |
|---|---|---|---|---|
| | Virus Neutralization Potency (µg/mL) | | | |
| Antibody | CHO77 | Bal | 92US657 | 8320 |
| A-1 | 0.12 | 0.16 | 1.31 | 0.31 |
| 1.2.2-1 | 0.12 | 0.23 | 1.38 | 0.70 |
| 1.3.1-1 | 0.08 | 0.26 | 1.84 | 0.37 |
| 1.4.1-1 | 0.04 | 0.21 | 1.35 | 0.28 |
| 1.5.1-1 | 0.14 | 0.26 | 0.85 | 0.50 |
| 1.6.1-1 | 0.10 | 0.39 | 1.32 | 0.62 |
| 1.7.1-1 | 0.10 | 0.51 | 1.10 | 0.54 |
| 1.8.1-1 | 0.09 | 0.04 | 1.88 | 0.59 |
| 1.9.1-1 | 0.17 | 0.20 | 1.39 | 0.50 |
| 1.15.1-1 | 0.10 | 0.17 | 1.42 | 0.31 |
| 1.18.1-1 | 0.10 | 0.12 | 1.78 | 0.33 |
| 1.21.1-1 | 0.17 | 0.11 | 2.51 | 0.59 |
| 1.22.1-1 | 0.95 | >20 | 11.3 | 13.2 |
| 1v2-1 | 0.07 | 0.08 | 0.88 | 0.28 |
| 1.25.1-1 | 0.12 | 0.17 | 1.46 | 0.23 |
| 1.26.1-1 | 0.11 | 0.06 | 0.93 | 0.38 |
| 1.27.1-1 | 0.13 | 0.54 | 0.56 | 0.58 |
| 1.28.1-1 | 0.10 | 0.11 | 1.63 | 0.38 |
| 1.29.1-1 | 0.09 | 0.14 | 1.33 | 0.41 |
| 1.30.1-1 | 0.06 | 0.15 | 0.93 | 0.39 |
| 1.1.2-1 | 0.14 | 0.20 | 0.62 | 0.78 |
| 1.1.4-1 | 0.12 | 0.10 | 1.44 | 0.35 |
| 1.1.5-1 | 0.12 | 0.21 | 1.93 | 0.63 |
| 1.1.10-1 | 0.07 | 0.10 | 0.60 | 0.33 |
| 1.1.11-1 | 0.13 | 0.09 | 1.17 | 0.39 |
| 1.1.12-1 | 0.12 | 0.06 | 1.64 | 0.50 |
| 1.1.13-1 | 0.09 | 0.19 | 1.43 | 0.45 |
| 1.1.17-1 | 0.10 | 0.08 | 1.27 | 0.52 |
| 1.1.19-1 | 0.12 | 0.09 | 0.90 | 0.34 |
| 1.1.26-1 | 0.13 | 0.07 | 1.49 | 0.45 |
| 1.1.27-1 | 0.10 | 0.12 | 1.25 | 0.53 |
| 1.14.15-1 | >20 | >20 | >20 | >20 |
| 1.33.1-1 | 0.17 | 0.11 | 0.95 | 0.77 |
| 1.33.32-1 | 0.08 | 0.09 | 0.83 | 0.35 |
| 1.34.32-1 | 0.11 | 0.31 | 1.47 | 0.54 |
| 1.36.35-1 | 0.32 | >20 | 5.37 | 3.82 |
| 1.36.36-1 | 0.30 | >20 | 2.07 | 3.84 |

Some antibodies displayed no loss of function in the ELISA assays (Table 14), but exhibited reduced potency in HIV neutralization assays (Table 23). Several antibodies showed either no change in virus neutralization activity or exhibited small gains in neutralization potency.

TABLE 24

| HIV Neutralization Potency on Antibodies Incorporating Mutations | | | | | | |
|---|---|---|---|---|---|---|
| | Virus Neutralization Potency (ug/mL) | | | | | |
| Antibody | BaL | 92US727 | 92HT593 | 92US657 | 92US712 | 302076 |
| A | 0.063 | 7.81 | 0.019 | 2.63 | 0.104 | 0.183 |
| A-1 | 0.037 | 6.08 | 0.013 | 2.160 | 0.085 | 0.145 |
| 1.1.10-1 | 0.021 | >20 | 0.013 | 1.83 | 0.088 | 0.131 |
| 1.1.42-1 | 0.030 | >20 | 0.046 | 2.14 | 0.078 | 0.157 |
| 1.33.32-1 | 0.063 | >20 | 0.010 | 1.39 | 0.062 | 0.077 |

TABLE 24-continued

HIV Neutralization Potency on Antibodies Incorporating Mutations

| Antibody | Virus Neutralization Potency (ug/mL) | |

TABLE 26-continued

HIV Neutralization Potency of Select Antibodies

| Virus | A-1 | 1.1.110-1 | 1.1.111-1 | 1.1.112-1 | 1.1.90-1 | 1.1.64-1 |
|---|---|---|---|---|---|---|
| RHPA | 0.19 | 0.20 | 0.16 | | 0.16 | 0.09 |
| WITO | 0.12 | 0.08 | 0.06 | | 0.07 | 0.13 |
| 7714 | 4.20 | 2.65 | 3.78 | | 3.76 | 7.48 |
| THRO | 6.84 | 6.77 | 6.20 | | 7.42 | 9.60 |
| CH040 | 4.86 | 6.86 | 16.1 | | 9.57 | 18.59 |
| 8089 | 0.32 | 1.30 | 0.60 | | 0.47 | 0.32 |
| 1489 | 0.09 | 0.08 | 0.10 | | 0.24 | 0.13 |
| 7467 | 0.03 | 0.03 | 0.04 | | 0.06 | 0.03 |
| 7352 | >50 | >50 | >50 | | >50 | 40.1 |
| 8320 | 0.28 | 0.26 | 0.25 | | 0.39 | 0.37 |
| 1003 | 1.25 | 1.35 | 1.17 | | 1.92 | 1.25 |
| 1012 | 1.24 | 1.65 | 1.43 | | 1.40 | 1.40 |
| 8398 | >50 | >50 | >50 | | >50 | >50 |
| 7576 | 0.38 | 0.50 | 0.32 | | 0.36 | 0.41 |
| 7051 | 0.21 | 0.25 | 0.19 | | 0.19 | 0.23 |
| 8176 | 0.18 | 0.18 | 0.19 | | 0.24 | 0.24 |
| 8106 | 0.57 | 0.61 | 0.61 | | 0.89 | 1.08 |
| 7552 | 27.24 | >50 | >50 | | >50 | 16.1 |

HIV neutralization potency was tested on select antibodies identified via mammalian display (Antibodies 1.1.110, 1.1.111 and 1.1.112) and those that showed reduced polyspecificity (Antibodies 1.1.90 and 1.1.64). Loss of potency was observed against viruses 92US727 and 7141 for the antibodies identified via mammalian display (Table 26).

TABLE 27

HIV Neutralization Results for Select Antibodies

| Virus | B-1 | 2.1.3-1 | 2.1.4-1 | A-1 | 1.1.54-1 | 1.1.90-1 | 1.1.111-1 | 1.1.113-1 |
|---|---|---|---|---|---|---|---|---|
| 92US712 | 0.10 | 0.20 | 0.11 | 0.10 | 0.07 | 0.09 | 0.08 | 0.07 |
| 8318 | 0.11 | 0.24 | 0.21 | 0.11 | 0.32 | 0.57 | 0.48 | 0.14 |
| 92HT593 | 0.35 | 0.30 | 0.33 | 0.41 | 0.26 | 0.39 | 0.29 | 0.24 |
| RHPA | 0.09 | 0.07 | 0.05 | 0.12 | 0.03 | 0.15 | 0.08 | 0.05 |
| 7051 | 0.41 | 0.42 | 0.46 | 0.52 | 0.23 | 0.44 | 0.32 | 0.41 |
| 8320 | 0.27 | 0.28 | 0.23 | 0.42 | 0.29 | 0.34 | 0.30 | 0.28 |
| 7576 | 0.24 | 0.49 | 0.55 | 0.34 | 0.48 | 0.41 | 0.26 | 0.28 |
| 7015 | 1.12 | 0.89 | 0.59 | 1.17 | 0.40 | 0.41 | 0.48 | 0.44 |
| 92US657 | 0.53 | 0.42 | 0.38 | 0.52 | 0.45 | 0.48 | 0.40 | 0.40 |
| CH106 | 1.51 | 1.01 | 0.91 | 0.91 | 0.90 | 1.00 | 0.86 | 0.59 |
| 1413 | 2.51 | 2.78 | 2.16 | 2.17 | 1.72 | 1.94 | 2.33 | 3.67 |
| 7141 | 1.67 | 13.76 | 6.78 | 2.45 | 1.61 | 2.24 | 29.81 | 27.85 |
| 92US727 | 2.13 | 14.34 | 7.27 | 2.01 | 11.18 | 2.17 | >50 | >50 |
| 7595 | 1.24 | 1.35 | 1.19 | 1.73 | 1.62 | 1.76 | 1.31 | 1.78 |
| CH040 | 0.14 | 0.47 | 0.36 | 0.57 | >50 | 22.06 | 3.71 | 0.15 |
| THRO | 5.32 | 6.56 | 4.97 | 6.30 | 5.47 | 10.62 | 8.58 | 9.39 |
| 7552 | 26.02 | >50 | >50 | 16.55 | 6.22 | 27.82 | >50 | >50 |
| 8339 | >50 | >50 | >50 | >50 | >50 | >50 | >50 | >50 |
| 7007 | >50 | >50 | >50 | >50 | >50 | >50 | >50 | >50 |
| 8398 | >50 | >50 | >50 | >50 | >50 | >50 | >50 | >50 |

The HIV neutralization results shown in in Table 27 suggest that removal of the N72 glycan (2.1.3-1, 2.1.4-1, 1.1.54-1, 1.1.111-1, and 1.1.113-1) may result in loss of neutralization sensitivity for select viruses (i.e., 7141, 92US727) compared to antibodies retaining the N72 glycan (Antibodies B-1, A-1, 1.1.90-1).

The antibodies tested in the high throughput BVP ELISA shown in Table 21 were examined in an HIV neutralization assay against 4 viruses. The results of this study are shown in Table 28.

TABLE 28

| HIV Neutralization Results | | | | |
|---|---|---|---|---|
| | Neutralization IC50 Values (μg/mL) for the Virus Indicated | | | |
| mAb | 92US712 | 92US727 | 7141 | VS001 |
| A-1 | 0.13 | 3.8 | 3 | 0.18 |
| 3-1 | 0.11 | 3.92 | 4.03 | 0.1 |
| 2.2.1-1 | 0.05 | ~6-11 | 1.61 | 0.1 |

TABLE 28-continued

HIV Neutralization Results

Neutralization IC50 Values (μg/mL) for the Virus Indicated

| mAb | 92US712 | 92US727 | 7141 | VS001 |
|---|---|---|---|---|
| 2.3.1-1 | 0.13 | ~4-12 | 2.65 | 0.2 |
| 1.1.64-1 | 0.05 | 0.55 | 0.64 | 0.05 |
| 3.1.8-1 | 0.12 | 1.15 | 3.51 | 0.11 |
| 2.2.8-1 | 0.07 | 3.38 | 1.6 | 0.07 |
| 2.3.8-1 | 0.07 | 1.72 | 1.64 | 0.15 |
| 1.1.67-1 | 0.1 | 8.1 | 3.76 | 0.15 |
| 3.1.9-1 | 0.11 | 3.54 | 4.35 | 0.16 |
| 2.2.9-1 | 0.06 | 13.1 | 1.75 | 0.15 |
| 2.3.9-1 | 0.09 | 11.1 | 2.56 | 0.22 |
| 1.1.115-1 | 0.08 | >50 | 10.1 | 0.75 |
| 3.1.10-1 | 0.34 | >50 | 44.8 | 2.24 |
| 2.2.10-1 | 0.05 | >50 | 4.31 | 0.79 |
| 2.3.10-1 | 0.09 | >50 | 15.3 | 0.94 |
| 1.1.116-1 | 0.12 | >36 | 14.6 | 0.44 |
| 3.1.11-1 | 0.07 | >44 | 8.7 | 0.57 |
| 2.2.11-1 | 0.04 | >50 | 2.65 | 0.4 |
| 2.3.11-1 | 0.07 | >50 | 11.2 | 0.83 |
| 1.1.117-1 | 0.09 | >50 | 16.9 | 3.03 |
| 3.1.12-1 | 0.11 | >41 | 24.5 | 2.41 |
| 2.2.12-1 | 0.04 | >50 | 7.08 | 2.1 |
| 2.3.12-1 | 0.09 | >50 | 23.8 | 1.92 |
| 1.1.118-1 | 0.18 | >50 | 20.2 | 2.4 |
| 3.1.13-1 | 0.1 | >21 | 13.2 | 0.56 |
| 2.2.13-1 | 0.08 | >50 | 3.8 | 1.48 |
| 2.3.13-1 | 0.14 | >38 | 15.5 | 1.5 |
| 1.1.10-1 | 0.12 | 45 | 5.43 | 0.17 |
| 3.1.14-1 | 0.12 | >27 | 6.42 | 0.19 |
| 2.2.14-1 | 0.06 | >50 | 2.26 | 0.21 |
| 2.3.14-1 | 0.11 | 35.3 | 5.23 | 0.21 |
| 1.1.54-1 | 0.16 | >50 | 7.08 | 0.32 |
| 3.1.5-1 | 0.14 | >17 | 9.8 | 0.23 |
| 2.2.5-1 | 0.05 | >50 | 2.34 | 0.13 |
| 2.3.5-1 | 0.05 | >50 | 3.52 | 0.19 |
| 1.1.104-1 | 0.12 | >50 | 5.13 | 0.45 |
| 3.1.15-1 | 0.12 | >33 | 9.1 | 0.49 |
| 2.2.15-1 | 0.03 | >50 | 1.99 | 0.37 |
| 2.3.15-1 | 0.1 | >50 | 5.93 | 0.85 |
| 1.1.119-1 | 0.08 | >50 | 6.92 | 0.39 |
| 3.1.7-1 | 0.09 | >50 | 5.65 | 0.3 |
| 2.2.7-1 | 0.04 | >50 | 1.58 | 0.27 |
| 2.3.7-1 | 0.07 | >50 | 5.08 | 0.47 |
| 1.1.42-1 | 0.29 | >50 | >50 | 0.9 |
| 3.1.2-1 | 0.09 | >50 | 21.9 | 0.73 |
| 2.2.2-1 | 0.04 | >50 | 2.06 | 0.44 |
| 2.3.2-1 | 0.1 | >50 | 14.6 | 0.88 |
| 1.1.75-1 | 0.08 | >50 | 11.3 | 0.5 |
| 3.1.16-1 | 0.29 | >43 | 39 | 2.15 |
| 2.2.16-1 | 0.05 | >50 | 3.38 | 0.78 |
| 2.3.16-1 | 0.09 | >50 | 10.2 | 0.72 |
| 1.1.78-1 | 0.1 | >50 | 29.5 | 3.3 |
| 3.1.17-1 | 0.1 | >50 | 25.5 | 2.21 |
| 2.2.17-1 | 0.05 | >50 | 6.28 | 4.38 |
| 2.3.17-1 | 0.08 | >50 | 31.3 | 4.54 |
| 1.1.102-1 | 0.14 | >50 | 22.7 | 3 |
| 3.1.18-1 | 0.24 | >9.8 | >9.8 | 3.52 |
| 2.2.18-1 | 0.09 | >34 | 5.04 | 2.51 |
| 2.3.18-1 | 0.16 | >23 | >23 | 2.37 |
| 1.1.120-1 | 0.2 | >32.9 | 17.8 | 0.88 |
| 3.1.19-1 | 0.1 | >50 | 23.9 | 0.57 |
| 2.2.19-1 | 0.06 | >50 | 4.83 | 1.04 |
| 2.3.19-1 | 0.09 | >50 | 12 | 0.48 |
| 1.1.121-1 | 0.1 | >37 | 28.7 | 1.3 |
| 3.1.20-1 | 0.06 | >50 | 22.1 | 0.95 |
| 2.2.20-1 | 0.05 | >50 | 4.01 | 1.25 |
| 2.3.20-1 | 0.08 | >50 | 15.9 | 1.23 |
| 1.1.122-1 | 0.13 | >42.4 | 6.79 | 0.32 |
| 1.1.123-1 | 0.09 | >43.8 | 11.2 | 0.23 |
| 1.1.124-1 | 0.14 | >25.4 | 9.87 | 0.3 |
| 1.1.125-1 | 0.12 | >50 | 7.69 | 0.37 |
| 1.1.126-1 | 0.12 | >50 | 6.49 | 0.35 |
| 1.1.127-1 | 0.16 | >23 | 5.78 | 0.18 |
| 1.1.128-1 | 0.17 | >28.3 | 9.5 | 0.67 |
| 1.1.129-1 | 0.15 | >29.7 | >29.7 | 2.09 |
| 1.1.130-1 | 0.21 | >27.3 | 16.7 | 1.67 |
| 1.1.131-1 | 0.15 | >31.9 | 16.4 | 0.57 |
| 1.1.111-1 | 0.13 | >50 | >50 | 3.24 |
| B-1 | 0.13 | 2.57 | 1.43 | 0.29 |
| 1.1.90-1 | 0.12 | 8.72 | 2.65 | 0.2 |
| 1.1.132-1 | 0.12 | 2.26 | 3.39 | 0.14 |
| 1.1.133-1 | 0.14 | 2.27 | 3.38 | 0.16 |
| 1.1.134-1 | 0.14 | 4.23 | 3.15 | 0.22 |
| 1.1.135-1 | 0.22 | 5.61 | 4 | 0.31 |
| 1.42.1-1 | 0.13 | 0.98 | 2.34 | 0.11 |
| 1.43.1-1 | 0.08 | 3.35 | 2.42 | 0.1 |
| 1.44.1-1 | 0.06 | ~7-12 | 1.43 | 0.13 |
| 1.45.1-1 | 9.8 | >50 | >50 | 27.6 |
| 1.46.1-1 | 0.17 | 1.68 | 2.44 | 0.24 |
| 1.47.1-1 | 0.11 | 1.17 | 2.48 | 0.24 |
| 1.49.1-1 | 0.14 | 2.41 | 2.98 | 0.26 |
| 1.50.1-1 | 0.08 | 0.92 | 2.54 | 0.14 |
| 1.51.1-1 | 0.1 | 2.67 | 3.5 | 0.22 |
| A-1 | 0.13 | 4.8 | 2.9 | 0.2 |

All antibodies carrying mutations at position N72 exhibited loss of function on the 92US727 virus. The antibody with the highest median potency was Antibody 1.1.64. Some antibodies show improvements in median neutralization potency compared to Antibody A-1. Among the antibodies containing the N72T mutation with reduced BVP ELISA scores, Antibody 2.3.5 also exhibited increased potency in the HIV neutralization assays.

Additional neutralization assays were conducted on a panel of variants designed to remove the heavy chain W74a oxidation motif and the light chain N26 deamidation motif in the A-1 variable domain. The results of the assessment are shown in Tables 29 and 30. The results show that many variants exhibited loss of function, while select variants retained potency more similar to A-1.

TABLE 29

HIV neutralization results for A-1 variants designed to remove chemical liabilities

| Liability Addressed | Antibody Name | Virus | | | | | | | |
|---|---|---|---|---|---|---|---|---|---|
| | | VS003 | VS046 | VS001 | VS026 | VS052 | US657 | VS043 | VS004 |
| None | A-1 | 0.03 | 0.03 | 0.08 | 0.26 | 0.38 | 0.86 | 1.47 | 3.42 |
| Light Chain N26 | 1.1.136-1 | 0.03 | 0.04 | 0.20 | 0.76 | 0.38 | 0.92 | 1.57 | >100 |
| | 1.1.137-1 | 0.03 | 0.05 | 0.16 | 0.43 | 0.35 | 0.78 | 1.65 | >100 |
| | 1.1.138-1 | 0.06 | 0.04 | 0.18 | 0.35 | 0.46 | 0.54 | 1.41 | 39.24 |
| | 1.1.139-1 | 0.03 | 0.05 | 0.36 | 0.94 | 0.51 | 0.54 | 1.37 | >100 |
| | 1.1.140-1 | 0.03 | 0.04 | 0.17 | 0.56 | 0.47 | 0.51 | 2.82 | 94.28 |
| | 1.1.141-1 | 0.02 | 0.04 | 0.25 | 0.69 | 0.51 | 0.38 | 1.30 | >100 |
| | 1.1.142-1 | 0.02 | 0.03 | 0.20 | 0.48 | 0.56 | 0.44 | 1.42 | >100 |

TABLE 29-continued

| HIV neutralization results for A-1 variants designed to remove chemical liabilities | | | | | | | | | |
|---|---|---|---|---|---|---|---|---|---|
| Liability | Antibody | Virus | | | | | | | |
| Addressed | Name | VS003 | VS046 | VS001 | VS026 | VS052 | US657 | VS043 | VS004 |
| | 1.1.143-1 | 0.05 | 0.05 | 0.40 | 3.85 | 0.92 | 0.82 | 2.05 | 89.88 |
| | 1.1.144-1 | 0.03 | 0.05 | 0.38 | 1.07 | 0.66 | 0.38 | 1.29 | >100 |
| Heavy | 1.52.1-1 | 0.05 | 0.06 | 0.21 | 0.48 | 0.54 | 0.69 | 1.39 | 9.90 |
| Chain | 1.53.1-1 | 0.06 | 0.05 | 0.18 | 0.49 | 0.57 | 0.72 | 1.44 | 14.10 |
| W74a | 1.54.1-1 | 0.08 | 0.06 | 0.55 | 0.59 | 0.75 | 1.27 | 1.94 | 36.15 |
| | 1.55.1-1 | 0.08 | 0.07 | 0.49 | 0.83 | 1.08 | 1.39 | 2.48 | 34.00 |
| | 1.56.1-1 | 0.09 | 0.07 | 0.49 | 0.72 | 0.87 | 1.28 | 1.51 | 21.80 |
| | 1.57.1-1 | 0.06 | 0.09 | 0.65 | 0.91 | 1.21 | 2.43 | 2.47 | 56.68 |

TABLE 30

HIV neutralization results for selected A-1 variants on an expanded viral panel

| Avg. IC50 (μg/mL) | Antibody A-1 | 1.1.136-1 | 1.1.137-1 | 1.1.138-1 | 1.1.140-1 | 1.1.142-1 | 1.52.1-1 | 1.53.1-1 |
|---|---|---|---|---|---|---|---|---|
| US657(1) | 0.864 | 0.92 | 0.78 | 0.55 | 0.55 | 0.51 | 0.44 | 0.73 |
| VS003 | 0.027 | 0.03 | 0.03 | 0.06 | 0.03 | 0.02 | 0.04 | 0.06 |
| VS046 | 0.029 | 0.04 | 0.05 | 0.04 | 0.04 | 0.03 | 0.05 | 0.05 |
| VS001 | 0.080 | 0.20 | 0.16 | 0.18 | 0.17 | 0.20 | 0.21 | 0.18 |
| VS026 | 0.259 | 0.76 | 0.43 | 0.35 | 0.56 | 0.48 | 0.48 | 0.50 |
| VS052 | 0.381 | 0.38 | 0.35 | 0.45 | 0.47 | 0.56 | 0.54 | 0.56 |
| VS043 | 1.466 | 1.57 | 1.65 | 1.41 | 2.82 | 1.42 | 1.39 | 1.44 |
| VS004 | 3.419 | >100 | >100 | 39.24 | >100 | >100 | 9.90 | 14.10 |
| US657(2) | 0.336 | 0.30 | 0.31 | 0.42 | 0.46 | 0.59 | 0.82 | 0.65 |
| VS002 | 0.024 | 0.02 | 0.03 | 0.03 | 0.03 | 0.02 | 0.05 | 0.05 |
| VS011 | 0.147 | 0.19 | 0.18 | 0.25 | 025 | 0.37 | 0.33 | 0.34 |
| VS017 | 0.443 | 2.14 | 1.75 | 2.02 | 2.13 | 2.87 | 3.01 | 3.03 |
| VS030 | 1.614 | 2.49 | 2.86 | 2.81 | 3.28 | 3.61 | 4.86 | 3.54 |
| VS032 | 0.256 | 0.27 | 0.28 | 0.25 | 0.20 | 0.17 | 0.27 | 0.25 |
| VS033 | 0.207 | 0.15 | 0.20 | 0.19 | 0.09 | 0.08 | 0.27 | 0.11 |
| VS034 | 0.358 | 0.54 | 0.40 | 0.45 | 0.23 | 0.33 | 0.28 | 0.45 |
| VS038 | 0.210 | 0.22 | 0.18 | 0.12 | 0.28 | 0.34 | 0.40 | 0.18 |
| VS039 | 0.121 | 0.10 | 0.07 | 0.07 | 0.05 | 0.07 | 0.17 | 0.15 |
| VS042 | 3.171 | 3.37 | 2.23 | 1.73 | 2.01 | 1.72 | 4.54 | 3.42 |
| VS044 | 0.312 | 0.73 | 0.39 | 0.36 | 0.06 | 0.07 | 0.16 | 0.12 |
| VS053 | 0.530 | 1.83 | 0.88 | 1.52 | 1.61 | 1.17 | 1.07 | 0.87 |

Next, select A-1 variants were profiled for impact of the mutations on neutralization breadth and potency, using a PhenoSense™ HIV Neutralization Assay (Monogram Biosciences; see also, Richman, et al., *Proc Natl Acad Sci USA*. (2003) 100(7):4144-9, Whitcomb, et al., Antimicrob Agents Chemother. (2007) 51(2):566-75), using reporter viruses pseudotyped with patient virus-derived envelopes (Table 31). The panel comprised 152 Env vectors in total (one vector per patient), with 133 clonal vectors and 19 isolates (representing the quasispecies in the sampled plasma). Briefly, the pseudoviruses were incubated with 5-fold serial dilutions of the antibody for 1 hour at 37° C. and then used to infect U87 cells expressing CD4, CCR5 and CXCR4 (CD4+/CCR5+/CXCR4+/U87). The ability of an antibody to neutralize HIV infectivity was assessed by measuring luciferase activity 72 hours post incubation of cells with virus. Virus and antibody controls were employed to monitor plate to plate performance within a run and to allow for comparison of runs over time. All test antibodies were screened against a control panel of viruses consisting of HIV-1 NL4.3 (CXCR4-tropic), JRCSF (CCR5-tropic), and MLV (non-HIV specificity control). A broadly neutralizing HIV+ plasma sample served as the antibody control. While some mutations had more subtle impact on activity, inducing either a slight reduction or slight gain in activity, other mutations induced a notable loss of neutralization breadth (Table 31 and FIG. 4).

TABLE 31

Neutralization potency and breadth of select antibodies were profiled against 152 patient-derived subtype B viruses obtained from pre-ART plasma.

| Name | Breadth [a] | Median $IC_{95}$, μg/mL [b] | Geomean $IC_{95}$, μg/mL [b] |
|---|---|---|---|
| A-1 | 89% | 2.66 | 3.06 |
| 1.1.90-1 | 86% | 2.59 | 3.01 |
| 1.1.64-1 | 92% | 2.25 | 2.70 |
| 1.1.10-1 | 86% | 1.93 | 2.53 |
| 1.52.1-1 | 83% | 3.66 | 4.33 |
| 1.52.90-1 | 78% | 4.42 | 4.56 |
| 1.1.138-1 | 82% | 2.59 | 2.96 |

[a] Breadth represents % viruses neutralized with an IC95 ≤ 50 &mug/mL

[b] Median and Geomean IC95 values calculated using only viruses with IC95 ≤ 50 μg/mL The neutralization data shown above was combined with the results of the polyspecificity screening (Example 9) and immunogenicity screening (Example 11) in order to design a pane of 12 lead variants. The panel of 12 EXPI293™-expressed antibodies tested in the BVP ELISA shown in Table 22 were next examined in an HIV neutralization assay against an expanded panel of viruses. The results for antibodies retaining the N72-linked glycan are shown in Table 32, while the results for antibodies lacking the N72-linked glycan are shown in Table 33.

TABLE 32

HIV Neutralization Potency of 7 antibodies retaining the N72-linked glycan tested using an expanded panel of viruses

| Virus | Virus Neutralization Potency (µg/mL) | | | | | | |
|---|---|---|---|---|---|---|---|
| | A-1 | 1.1.64-1 | 1.52.64-1 | 1.1.90-1 | 2.2.1-1 | 2.4.1-1 | 2.3.1-1 |
| 1003 | 1.79 | 2.97 | 3.29 | 1.17 | 1.61 | 3.62 | 1.87 |
| 1012 | 1.41 | 1.41 | 1.71 | 2.92 | 3.70 | 3.38 | 1.55 |
| 1413 | 5.31 | 4.22 | 7.79 | 2.07 | 4.13 | 5.04 | 5.28 |
| 1489 | 0.12 | 0.16 | 0.17 | 0.22 | 0.26 | 0.16 | 0.18 |
| 7015 | 0.53 | 0.65 | 0.98 | 0.63 | 0.47 | 0.54 | 0.63 |
| 7051 | 0.79 | 2.05 | 0.82 | 0.83 | 0.97 | 1.18 | 0.52 |
| 7103 | 0.76 | 1.56 | 1.09 | 1.75 | 1.72 | 1.31 | 0.94 |
| 7141 | 2.32 | 1.82 | 30.02 | 2.66 | 3.93 | 4.82 | 1.62 |
| 7467 | 0.04 | 0.06 | 0.07 | 0.05 | 0.03 | 0.05 | 0.06 |
| 7552 | 12.04 | >80 | 50.05 | >80 | 39.62 | 37.05 | 20.69 |
| 7576 | 0.69 | 0.39 | 1.46 | 1.42 | 0.70 | 1.40 | 0.92 |
| 7595 | 4.88 | 1.71 | 7.34 | 10.46 | 9.72 | 5.06 | 8.50 |
| 7714 | 4.20 | ND | ND | ND | ND | ND | ND |
| 8106 | 2.72 | 3.31 | 8.15 | 4.54 | 2.46 | 4.25 | 3.12 |
| 8110 | 3.64 | 6.74 | 7.04 | 3.16 | 3.62 | 5.14 | 3.48 |
| 8117 | 0.86 | 1.77 | 2.18 | 1.47 | 0.94 | 2.58 | 2.08 |
| 8134 | 1.57 | 0.60 | 3.66 | 3.78 | 1.52 | 1.05 | 2.27 |
| 8176 | 0.26 | 0.66 | 0.34 | 0.27 | 0.30 | 0.33 | 0.30 |
| 8318 | 0.27 | 0.33 | 0.42 | 0.39 | 0.36 | 0.40 | 0.31 |
| 8320 | 2.20 | 2.89 | 3.82 | 3.22 | 3.88 | 6.69 | 2.88 |
| 302076 | 0.08 | 0.08 | 0.11 | 0.08 | 0.07 | 0.13 | 0.10 |
| 92HT593 | 0.27 | 0.37 | 0.25 | 0.22 | 0.17 | 0.37 | 0.29 |
| 92US657 | 0.38 | 0.42 | 0.48 | 0.40 | 0.25 | 0.34 | 0.36 |
| 92US712 | 0.06 | 0.06 | 0.13 | 0.05 | 0.05 | 0.07 | 0.06 |
| 92US727 | 2.43 | 1.12 | 5.47 | 8.61 | 4.84 | 13.74 | 2.02 |
| CHO77 | 0.04 | 0.04 | 0.12 | 0.06 | 0.02 | 0.08 | 0.03 |
| REJO | 0.01 | 0.02 | 0.02 | 0.04 | 0.01 | 0.02 | 0.02 |
| THRO | 2.80 | 3.87 | 3.11 | 2.04 | 2.17 | 4.17 | 3.96 |
| VS001 | 0.06 | 0.06 | 0.11 | 0.10 | 0.08 | 0.18 | 0.07 |
| VS004 | 2.66 | 2.43 | 4.74 | 3.21 | 2.84 | 6.08 | 1.92 |
| VS017 | 0.70 | 0.91 | 2.01 | 1.08 | 0.84 | 3.91 | 0.88 |
| VS026 | 0.11 | 0.17 | 0.23 | 0.20 | 0.13 | 0.27 | 0.13 |
| VS030 | 2.04 | 2.60 | 7.98 | 7.40 | 2.51 | 5.20 | 6.38 |
| VS039 | 0.12 | 0.09 | 0.27 | 0.14 | 0.03 | 0.11 | 0.06 |
| VS042 | 2.53 | 2.33 | 4.44 | 1.88 | 0.89 | 2.00 | 1.11 |
| VS043 | 0.79 | 0.85 | 1.30 | 1.11 | 1.01 | 1.16 | 0.97 |
| VS044 | 0.18 | 0.16 | 0.38 | 0.26 | 0.13 | 0.25 | 0.16 |
| VS046 | 0.04 | 0.04 | 0.05 | 0.03 | 0.03 | 0.05 | 0.03 |
| VS049 | 39.54 | 32.19 | >100 | >100 | 2.89 | >100 | 4.86 |
| VS052 | 0.28 | 0.45 | 0.61 | 0.64 | 0.24 | 0.50 | 0.33 |

TABLE 33

HIV Neutralization potency of 5 antibodies lacking the N72 glycan using an expanded panel of viruses

| Virus | Virus Neutralization Potency (µg/mL) | | | | |
|---|---|---|---|---|---|
| | 1.1.104-1 | 1.1.119-1 | 3.1.5-1 | 2.2.5-1 | 2.3.5-1 |
| 1003 | 1.44 | 0.91 | 1.02 | 0.78 | 1.06 |
| 1012 | 2.87 | 1.06 | 1.19 | 0.98 | 1.63 |
| 1413 | 4.34 | 4.52 | 4.30 | 3.62 | 3.79 |
| 1489 | 0.28 | 0.17 | 0.16 | 0.11 | 0.14 |
| 7015 | 0.67 | 1.08 | 1.16 | 0.95 | 1.89 |
| 7051 | 1.32 | 1.89 | 1.27 | 3.51 | 4.46 |
| 7103 | 1.82 | 1.16 | 0.91 | 0.78 | 1.05 |
| 7141 | 6.57 | 4.98 | 3.31 | 1.75 | 2.41 |
| 7467 | 0.06 | 0.19 | 0.12 | 0.07 | 0.09 |
| 7552 | >80 | >80 | >80 | >80 | >80 |
| 7576 | 1.10 | 0.60 | 0.55 | 0.58 | 0.61 |
| 7595 | 8.47 | 3.07 | 3.56 | 2.94 | 3.07 |
| 7714 | ND | 1.93 | 1.50 | 0.80 | 1.47 |
| 8106 | 2.80 | 1.44 | 1.45 | 0.94 | 1.44 |
| 8110 | 4.19 | 2.37 | 1.81 | 1.10 | 1.82 |

TABLE 33-continued

HIV Neutralization potency of 5 antibodies lacking the N72 glycan using an expanded panel of viruses

| Virus | Virus Neutralization Potency (µg/mL) | | | | |
|---|---|---|---|---|---|
| | 1.1.104-1 | 1.1.119-1 | 3.1.5-1 | 2.2.5-1 | 2.3.5-1 |
| 8117 | 1.22 | 1.66 | 1.02 | 0.75 | 1.06 |
| 8134 | 6.07 | 3.44 | 2.78 | 1.74 | 1.52 |
| 8176 | 0.16 | 0.27 | 0.30 | 0.20 | 0.33 |
| 8318 | 0.32 | 0.42 | 0.36 | 0.33 | 0.41 |
| 8320 | 4.34 | 1.47 | 1.33 | 1.21 | 1.48 |
| 302076 | 0.10 | 0.08 | 0.06 | 0.06 | 0.06 |
| 92HT593 | 0.28 | 0.15 | 0.16 | 0.11 | 0.17 |
| 92US657 | 0.36 | 0.30 | 0.27 | 0.15 | 0.24 |
| 92US712 | 0.04 | 0.03 | 0.06 | 0.04 | 0.05 |
| 92US727 | 10.55 | 43.70 | 11.98 | 16.74 | 9.32 |
| CHO77 | 0.03 | 0.02 | 0.04 | 0.02 | 0.04 |
| REJO | 0.02 | 0.03 | 0.02 | 0.01 | 0.02 |
| THRO | 4.27 | 2.80 | 2.70 | 1.22 | 2.34 |
| VS001 | 0.34 | 0.37 | 0.10 | 0.10 | 0.13 |
| VS004 | 4.80 | 6.02 | 1.55 | 3.22 | 2.77 |
| VS017 | 2.33 | 2.75 | 1.03 | 0.77 | 0.70 |
| VS026 | 0.19 | 0.14 | 0.10 | 0.06 | 0.10 |
| VS030 | 7.90 | 4.96 | 6.86 | 4.22 | 6.23 |
| VS039 | 0.10 | 0.13 | 0.12 | 0.06 | 0.15 |
| VS042 | 2.33 | 2.19 | 1.94 | 1.21 | 1.56 |
| VS043 | 1.49 | 0.81 | 0.54 | 0.41 | 0.79 |
| VS044 | 0.28 | 0.20 | 0.16 | 0.12 | 0.17 |
| VS046 | 0.03 | 0.03 | 0.03 | 0.03 | 0.04 |
| VS049 | >100 | >100 | 20.37 | 10.85 | 36.15 |
| VS052 | 0.27 | 0.39 | 0.31 | 0.20 | 0.31 |

The results in Tables 32 and 33 show that all 12 antibody variants tested have similar virus neutralization potency values on the expanded panel of viruses. A subset of variants were also profiled for neutralization breadth and potency via the phenosense neutralization assay, using a panel of 141 reporter viruses pseudotyped with subtype B patient virus-derived envelopes (Table 34 and FIG. 5). Each envelope vector comprised isolate sampled from one patient. The variants exhibited comparable neutralization potency and breadth.

TABLE 34

Neutralization Activity of mAb Variants Profiled Against HIV-1 Pseudotyped with Env from Subtype B Plasma Isolates

| | A | A-1 | 1.52.64-1 |
|---|---|---|---|
| Breadth [a] | 87% | 87% | 86% |
| Median IC$_{95}$, µg/mL [b] | 1.72 | 1.93 | 2.00 |
| Geomean IC$_{95}$, µg/mL [b] | 2.26 | 2.23 | 2.94 |

[a] Breadth represents % viruses neutralized with an IC95 ≤ 50 µg/mL
[b] Median and Geomean IC95 values calculated using only viruses with IC95 ≤ 50 µg/mL

Example 11: In Vitro Whole Molecule T-Cell Proliferation and IL2 Release

Host anti-drug-antibody (ADA) responses can negatively impact the efficacy and pharmacokinetics of therapeutic antibodies and the resulting immune complexes may present safety concerns (Pratt K P. 2018. Antibodies. 7:19, Krishna M and Nadler S G. 2016. Front. Immunol. 7:21). As a result, in vitro T-cell proliferation and IL2 release assays such as the EPISCREEN™ functional assays (Abzena Ltd.) have been developed to assess the overall immunogenic risk of biotherapeutics. The EPISCREEN™ measures biotherapeutic induced IL2 release via the Enzyme Linked Immunosorbent Spot (ELISpot) assay and T-cell proliferation via 3H-thymidine incorporation in CD8+ T-cell depleted primary PMBC cultures obtained from 50 donors selected to represent HLA allotypes expressed among the world population. A highly immunogenic protein such as keyhole limpet hemocyanin (KLH) will induce both IL2 release and T-cell proliferation in >80% of donors, approved biotherapeutics such as Alemtuzumab and Infliximab with high rates of clinical immunogenicity will induce response rates in 25%-40% of donors, while biotherapeutics with low immunogenic risk typically show donor response rates ≤10%. Donor response rates in the EPISCREEN™ have been shown to correlate with clinical ADA rates (Baker and Jones 2007. Curr. Opin. Drug Discov. Devel. 10: 219-227).

Table 35 shows the results of the EPISCREEN™ assay for a panel of anti gp120 bNAbs that were transiently expressed in EXPI293™ cells and purified using protein A and size exclusion chromatography. Also shown are the A33 antibody and KLH as positive controls. In contrast to the immunogenic positive control proteins, many of the anti-gp120 antibodies tested, including A-1, show unusually high T-cell proliferation rates, but have relatively low IL2 release rates. This data suggests that in the absence of target, A-1 and other anti-gp120 bNAbs may directly stimulate $^3$H-thymidine incorporation in primary human PBMCs in vitro via an unknown mechanism. This unknown mechanisms, hereafter referred to as "off-target activity" could present safety liabilities if it translated in-vivo.

TABLE 35

EpiScreen ™ results for 10 Expi293 ™ expressed anti-gp120 Abs tested on PBMCs from 50 donors.

| Ab Name | Lot # | Expression Cell Line | $^3$H-thymidine incorporation (%) | IL2 Release (%) | $^3$H + IL2 (%) |
|---|---|---|---|---|---|
| E | 3 | Expi293 ™ | 16 | 6 | 4 |
| A-1 | 3 | Expi293 ™ | 32 | 6 | 6 |
| F | 4 | Expi293 ™ | 60 | 10 | 10 |
| G | 4 | Expi293 ™ | 60 | 8 | 8 |
| H | 4 | Expi293 ™ | 50 | 14 | 12 |
| I | 3 | Expi293 ™ | 56 | 16 | 10 |
| J | 4 | Expi293 ™ | 6 | 14 | 4 |
| K | 4 | Expi293 ™ | 16 | 6 | 2 |
| E-7 | 2 | Expi293 ™ | 14 | 10 | 2 |
| E-6 | 2 | Expi293 ™ | 10 | 8 | 2 |
| A33 | NA | NA | 20 | 22 | 14 |
| KLH | NA | NA | 90 | 82 | 80 |

Response rates (%) indicate the percent of 50 donors showing responses in the indicated assays.

The heavy and light chains of antibodies E, F, G, H, I, J, K, L, L-1, E-6 and E-7 are provided in Table 36.

TABLE 36

COMPARISON/CONTROL ANTIBODIES

| Ab Name | Heavy Chain (HC) Amino Acid Sequence | Light Chain Amino Acid Sequence |
|---|---|---|
| E | EVQLVESGGGLVKAGGSLILSCGVSNFRISAHTMNWVRRVPGGGLEWVASISTSST YRDYADAVKGRFTVSRDDLEDFVYLQMHKMRVEDTAIYYCARKGSDRLSDNDPFDA WGPGTVVTVSPASTKGPSVFPLAPSSKSTSGGTAALGCLVKDYFPEPVTVSWNSGA | DVVMTQSPSTLSASVGDTITITCRASQSIET WLAWYQQKPGKAPKLLIYKASTLKTGVPSRF SGSGSGTEFTLTISGLQFDDFATYHCQHYAG |

TABLE 36-continued

COMPARISON/CONTROL ANTIBODIES

| Ab Name | Heavy Chain (HC) Amino Acid Sequence | Light Chain Amino Acid Sequence |
|---|---|---|
| | LTSGVHTFPAVLQSSGLYSLSSVVTVPSSSLGTQTYICNVNHKPSNTKVDKKVEPK SCDKTHTCPPCPAPELLGGPSVFLFPPKPKDTLMISRTPEVTCVVVDVSHEDPEVK FNWYVDGVEVHNAKTKPREEQYNSTYRVVSVLTVLHQDWLNGKEYKCKVSNKALPA PIEKTISKAKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHNHYTQKSLS LSPGK (SEQ ID NO: 632) | YSATFGQGTRVEIKRTVAAPSVFIFPPSDEQ LKSGTASVVCLLNNFYPREAKVQWKVDNALQ SGNSQESVTEQDSKDSTYSLSSTLTLSKADY EKHKVYACEVTHQGLSSPVTKSFNRGEC (SEQ ID NO: 643) |
| F | EVQLVQSGTQMKEPGASVTISCVTSGYEFVEILINWVRQVPGRGLEWMGWMNPRGG GVNYARQFQGKVTMTRDVYRDTAYLTLSGLTSGDTAKYFCVRGRSCCGGRRHCNGA DCFNWDFQHWGQGTLVIVSPASTKGPSVFPLAPSSKSTSGGTAALGCLVKDYFPEP VTVSWNSGALTSGVHTFPAVLQSSGLYSLSSVVTVPSSSLGTQTYICNVNHKPSNT KVDKKVEPKSCDKTHTCPPCPAPELLAGPDVFLFPPKPKDTLMISRTPEVTCVVVD VSHEDPEVKFNWYVDGVEVHNAKTKPREEQYNSTYRVVSVLTVLHQDWLNGKEYKC KVSNKALPLPEEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVLHEALH SHYTQKSLSLSPGK (SEQ ID NO: 633) | YIGVTQSPAILSVSLGERVTLSCKTSQAITP RHLVWHRQKGGQAPSLVMTGTSERASGIPDR FIGSGSGTDFTLTITRLEAEDFAVYYCQCLE GTASVVCLLNNFYPREAKVQWKVDNALQSGN SQESVTEQDSKDSTYSLSSTLTLSKADYEKH KVSNKALPLPEEKTISKAKGQPREPQVYTLP PSREEMTKNQVSLTCLVKGFYPSDIAVEWES NGQPENNYKTTPPVLDSDGSFFLYSKLTVDK SRWQQGNVFSCSVLHEALHSHYTQKSLSLSP GK (SEQ ID NO: 644) |
| G | EVQLVQSGTQMKEPGASVTISCVTSGYEFVEILINWVRQVPGRGLEWMGWMNPRGG GVNYARQFQGKVTMTRDVYRDTAYLTLSGLTSGDTAKYFCVRGKSCCAGRRFCGPT DCYNWDFAHWGQGTLVIVSPASTKGPSVFPLAPSSKSTSGGTAALGCLVKDYFPEP VTVSWNSGALTSGVHTFPAVLQSSGLYSLSSVVTVPSSSLGTQTYICNVNHKPSNT KVDKKVEPKSCDKTHTCPPCPAPELLAGPDVFLFPPKPKDTLMISRTPEVTCVVVD VSHEDPEVKFNWYVDGVEVHNAKTKPREEQYNSTYRVVSVLTVLHQDWLNGKEYKC KVSNKALPLPEEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVLHEALH SHYTQKSLSLSPGK (SEQ ID NO: 634) | EIVLTQSPGTLSLSPGETAIISCRTSQYGSL AWYQQRPGQAPRLVIYSGSTRAAGIPDRFSG SRWGPDYNLTISNLESGDFGVYYCQQYEFFG QGTKVQVDIKRTVAAPSVFIFPPSDEQLKSG TASVVCLLNNFYPREAKVQWKVDNALQSGNS QESVTEQDSKDSTYSLSSTLTLSKADYEKHK KVSNKALPLPEEKTISKAKGQPREPQVYTLP PSREEMTKNQVSLTCLVKGFYPSDI VYACEVTHQGLSSPVTKSFNRGEC (SEQ ID NO: 645) |
| H | QVRLSQSGGQMKKPGDSMRISCRASGYEFINCPINWIRLAPGKRPEWMGWMKPRGG AVSYARQLQGRVTMTRDMYSETAFLELRSLTSDDTAVYFCTRGKYCTARDYYNWDF EHWGQGTPVTVSSASTKGPSVFPLAPSSKSTSGGTAALGCLVKDYFPEPVTVSWNS GALTSGVHTFPAVLQSSGLYSLSSVVTVPSSSLGTQTYICNVNHKPSNTKVDKKVE PKSCDKTHTCPPCPAPELLAGPDVFLFPPKPKDTLMISRTPEVTCVVVDVSHEDPE VKFNWYVDGVEVHNAKTKPREEQYNSTYRVVSVLTVLHQDWLNGKEYKCKVSNKAL PLPEEKTISKAKGQPREPQVYTLPPSREEMTKNQVSLTCLVKGFYPSDIAVEWESN GQPENNYKTTPPVLDSDGSFFLYSKLTVDKSRWQQGNVFSCSVLHEALHSHYTQKS LSLSPGK (SEQ ID NO: 635) | EIVLTQSPGTLSLSPGETAIISCRTSQYGSL AWYQQRPGQAPRLVIYSGSTRAAGIPDRFSG SRWGPDYNLTISNLESGDFGVYYCQQYEFFG QGTKVQVDIKRTVAAPSVFIFPPSDEQLKSG TASVVCLLNNFYPREAKVQWKVDNALQSGNS QESVTEQDSKDSTYSLSSTLTLSKADYEKHK KVSNKALPLPEEKTISKAKGQPREPQVYTLP PSREEMTKNQVSLTCLVKGFYPSDI VYACEVTHQGLSSPVTKSFNRGEC (SEQ ID NO: 646) |
| I | RVQLVESGGGVVQPGKSVRLSCVVSDFPPFSKYPMYWVRQAPGKGLEWVAAISGDAW HVVYSNSVQGRELVSRDNVKNTLYLEMNSLKIEDTAVYRCARMFQESGPPRLDRWS GRNYYYYSGMDVWGQGTTVTVSSASTKGPSVFPLAPSSKSTSGGTAALGCLVKDYF PEPVTVSWNSGALTSGVHTFPAVLQSSGLYSLSSVVTVPSSSLGTQTYICNVNHKP SNTKVDKKVEPKSCDKTHTCPPCPAPELLAGPDVFLFPPKPKDTLMISRTPEVTCV VVDVSHEDPEVKFNWYVDGVEVHNAKTKPREEQYNSTYRVVSVLTVLHQDWLNGKE YKCKVSNKALPLPEEKTISKAKGQPREPQVYTLPPSREEMTKNQVSLTCLVKGFYP SDIAVEWESNGQPENNYKTTPPVLDSDGSFFLYSKLTVDKSRWQQGNVFSCSVLHE ALHSHYTQKSLSLSPGK (SEQ ID NO: 636) | DIVMTQTPLSLSVTPGQPASISCKSSESLRQ SNGKTSLYWYRQKPGQSPQLLVFEVSNRFSG VSDRFVGSGSGTDFTLRISRVEAEDVGFYYC MQSKDFPLTFGGGTKVDLKRTVAAPSVFIFP PSDEQLKSGTASVVCLLNNFYPREAKVQWKV VDNALQSGNSQESVTEQDSKDSTYSLSSTLTL SKADYEKHKVYACEVTHQGLSSPVTKSFNRG EC (SEQ ID NO: 647) |
| J | QEQLVESGGGVVQPGGSLRLSCLASGFTFHKYGMHWVRQAPGKGLEWVALISDDGM RKYHSDSMWGRVTISRDNSKNTLYLQFSSLKVEDTAMFFCAREAGGPIWHDDVKYY DENDGYYNYHYMDVWGKGTTVTVSSASTKGPSVFPLAPSSKSTSGGTAALGCLVKD YFPEPVTVSWNSGALTSGVHTFPAVLQSSGLYSLSSVVTVPSSSLGTQTYICNVNH KPSNTKVDKKVEPKSCDKTHTCPPCPAPELLAGPDVFLFPPKPKDTLMISRTPEVT CVVVDVSHEDPEVKFNWYVDGVEVHNAKTKPREEQYNSTYRVVSVLTVLHQDWLNG KEYKCKVSNKALPLPEEKTISKAKGQPREPQVYTLPPSREEMTKNQVSLTCLVKGF YPSDIAVEWESNGQPENNYKTTPPVLDSDGSFFLYSKLTVDKSRWQQGNVFSCSVL HEALHSHYTQKSLSLSPGK (SEQ ID NO: 637) | QSALTQPASVSGSPGQTITISCNGTSSDVGG QSALTQPASVSGSPGQTITISCNGTSSDVGG FDSVSWYQQSPGKAPKVMVFDVSHRPSGISN RFSGSKSGNTASLTISGLHIEDEGDYFCSSL TDRSHRIEGGGTKVTVLGQPKAAPSVTLEPP SSEELQANKATLVCLISDFYPGAVTVAWKAD SSPVKAGVETTTPSKQSNNKYAASSYLSLTP EQWKSHRSYSCQVTHEGSTVEKTVAPTECS (SEQ ID NO: 648) |
| K | QVQLVQSGAEVKKPGSSVKVSCKASGNSFSNHDVHWVRQATGQGLEWMGWMSHEGD KTGLAQKFQGRVTITRDSGASTVYMELRGLTADDTAIYYCLTGSKHRLRDYFLYNE YGPNYEEWGDYLATLDVWGHGTAVTVSSASTKGPSVFPLAPSSKSTSGGTAALGCL VKDYFPEPVTVSWNSGALTSGVHTFPAVLQSSGLYSLSSVVTVPSSSLGTQTYICN VNHKPSNTKVDKKVEPKSCDKTHTCPPCPAPELLAGPDVFLEPPKPKDTLMISRTP EVTCVVVDVSHEDPEVKFNWYVDGVEVHNAKTKPREEQYNSTYRVVSVLTVLHQDW LNGKEYKCKVSNKALPLPEEKTISKAKGQPREPQVYTLPPSREEMTKNQVSLTCLV KGFYPSDIAVEWESNGQPENNYKTTPPVLDSDGSFFLYSKLTVDKSRWQQGNVFSC SVLHEALHSHYTQKSLSLSPGK (SEQ ID NO: 638) | EVVITQSPLFLPVTPGEAASLSCKCSHSLQH STGANYLAWYLQRPGQTPRLLIHLATHRASG VPDRFSGSGSGTDFTLKISRVESDDVGTYYC MQGLHSPWTFGQGTKVEIKRTVAAPSVFIFP PSDEQLKSGTASVVCLLNNFYPREAKVQWKV DNALQSGNSQESVTEQDSKDSTYSLSSTLTL SKADYEKHKVYACEVTHQGLSSPVTKSFNRG EC (SEQ ID NO: 649) |
| L | QVQLVQSGGGQMKKPGESMRISCRASGYEFIDCTLNWIRLAPGKRPEWMGWLKPRGG AVNYARPLQGRVTMTRDVYSDTAFLELRSLTVDDTAVYFCTRGKNCDYNWDFEHWG RGTPVIVSSASTKGPSVFPLAPSSKSTSGGTAALGCLVKDYFPEPVTVSWNSGALT SGVHTFPAVLQSSGLYSLSSVVTVPSSSLGTQTYICNVNHKPSNTKVDKKVEPKSC DKTHTCPPCPAPELLGGPSVFLFPPKPKDTLMISRTPEVTCVVVDVSHEDPEVKFN | EIVLTQSPGTLSLSPGETAIISCRTSQYGSL AWYQQRPGQAPRLVIYSGSTRAAGIPDRFSG SRWGPDYNLTISNLESGDFGVYYCQQYEFFG QGTKVQVDIKRTVAAPSVFIFPPSDEQLKSG TASVVCLLNNFYPREAKVQWKVDNALQSGNS |

TABLE 36-continued

COMPARISON/CONTROL ANTIBODIES

| Ab Name | Heavy Chain (HC) Amino Acid Sequence | Light Chain Amino Acid Sequence |
|---|---|---|
| | WYVDGVEVHNAKTKPREEQYNSTYRVVSVLTVLHQDWLNGKEYKCKVSNKALPAPI EKTISKAKGQPREPQVYTLPPSREEMTKNQVSLTCLVKGFYPSDIAVEWESNGQPE NNYKTTPPVLDSDGSFFLYSKLTVDKSRWQQGNVFSCSVMHEALHNHYTQKSLSLS PGK (SEQ ID NO: 639) | QESVTEQDSKDSTYSLSSTLTLSKADYEKHK VYACEVTHQGLSSPVTKSFNRGEC (SEQ ID NO: 650) |
| L-1 | QVQLVQSGGGQMKKPGESMRISCRASGYEFIDCTLNWIRLAPGKRPEWMGWLKPRGG AVNYARPLQGRVTMTRDVYSDTAFLELRSLTVDDTAVYFCTRGKNCDYNWDFEHWG RGTPVIVSSASTKGPSVFPLAPSSKSTSGGTAALGCLVKDYFPEPVTVSWNSGALT SGVHTFPAVLQSSGLYSLSSVVTVPSSSLGTQTYICNVNHKPSNTKVDKKVEPKSC DKTHTCPPCPAPELLGGPSVFLFPPKPKDTLMISRTPEVTCVVVDVSHEDPEVKFN WYVDGVEVHNAKTKPREEQYNSTYRVVSVLTVLHQDWLNGKEYKCKVSNKALPAPI EKTISKAKGQPREPQVYTLPPSREEMTKNQVSLTCLVKGFYPSDIAVEWESNGQPE NNYKTTPPVLDSDGSFFLYSKLTVDKSRWQQGNVFSCSVMHEALHNHYTQKSLSLS PGK (SEQ ID NO: 640) | EIVLTQSPGTLSLSPGETAIISCRTSQYGSL AWYQQRPGQAPRLVIYSGSTRAAGIPDRFSG SRWGPDYNLTISNLESGDFGVYYCQQYEFFG QGTKVQVDIKRTVAAPSVFIFPPSDEQLKSG TASVVCLLNNFYPREAKVQWKVDNALQSGNS QESVTEQDSKDSTYSLSSTLTLSKADYEKHK VYACEVTHQGLSSPVTKSFNRGEC (SEQ ID NO: 651) |
| E-6 | EVQLVESGGGLVKAGGSLILSCGVSNFRISAHTMNWVRRVPGGGLEWVASISTSST YRDYADAVKGRFTVSRDDLEDFVYLQMHKMRVEDTAIYYCARKGSDRLSDNDPFDA WGPGTVVTVSPASTKGPSVFPLAPSSKSTSGGTAALGCLVKDYFPEPVTVSWNSGA LTSGVHTFPAVLQSSGLYSLSSVVTVPSSSLGTQTYICNVNHKPSNTKVDKKVEPK SCDKTHTCPPCPAPELLGGPSVFLLPPKPKDTLMISRTPEVTCVVVDVSHEDPEVK FNWYVDGVEVHNAKTKPPEEQYNSTLRVVSILTVLHQDWLNGKEYKCKVSNKALPA PIEKTISKAKGQPREPQVYTLPPSREEMTKNQVSLTCLVKGFYPSDIAVEWESNGQ PENNYKTTPLVLDSDGSFFLYSKLTVDKSRWQQGNVFSCSVLHEALHSHYTQKSLS LSPGK (SEQ ID NO: 641) | DVVMTQSPSTLSASVGDTITITCRASQSIET WLAWYQQKPGKAPKLLIYKASTLKTGVPSRF SGSGSGTEFTLTISGLQFDDFATYHCQHYAG YSATFGQGTRVEIKRTVAAPSVFIFPPSDEQ LKSGTASVVCLLNNFYPREAKVQWKVDNALQ SGNSQESVTEQDSKDSTYSLSSTLTLSKADY EKHKVYACEVTHQGLSSPVTKSFNRGEC (SEQ ID NO: 652) |
| E-7 | EVQLVESGGGLVKAGGSLILSCGVSNFRISAHTMNWVRRVPGGGLEWVASISTSST YRDYADAVKGRFTVSRDDLEDFVYLQMHKMRVEDTAIYYCARKGSDRLSDNDPFDA WGPGTVVTVSPASTKGPSVFPLAPSSKSTSGGTAALGCLVKDYFPEPVTVSWNSGA LTSGVHTFPAVLQSSGLYSLSSVVTVPSSSLGTQTYICNVNHKPSNTKVDKKVEPK SCDKTHTCPPCPAPELVGGPSVFLLPPKPKDTLMISRTPEVTCVVVDVSHEDPEVK FNWYVDGVEVHNAKTKPPEEQYNSTLRVVSVLTVLHQDWLNGKEYKCKVSNKALPA PIEKTISKAKGQPREPQVYTLPPSREEMTKNQVSLTCLVKGFYPSDIAVEWESNGQ PENNYKTTPLVLDSDGSFFLYSKLTVDKSRWQQGNVFSCSVLHEALHSHYTQKSLS LSPGK (SEQ ID NO: 642) | DVVMTQSPSTLSASVGDTITITCRASQSIET WLAWYQQKPGKAPKLLIYKASTLKTGVPSRF SGSGSGTEFTLTISGLQFDDFATYHCQHYAG YSATFGQGTRVEIKRTVAAPSVFIFPPSDEQ LKSGTASVVCLLNNFYPREAKVQWKVDNALQ SGNSQESVTEQDSKDSTYSLSSTLTLSKADY EKHKVYACEVTHQGLSSPVTKSFNRGEC (SEQ ID NO: 653) |

To better understand the unexpected off-target activity of A-1, we conducted a second EPISCREEN™ assay on A-1 and variants described herein lacking the N72 linked glycosylation motif in the A-1 light chain. To determine if expression-host-dependent N72-linked glycan composition changes (Example 14, below) might impact the off-target activity of A-1, proteins for the second EPISCREEN™ assay were expressed in the EXPICHO™ cell line rather than the Expi293™ cell line. The results of this EPISCREEN™ assay are shown in Table 37. Antibody A-1 expressed in the EXPICHO™ cell line showed lower T-cell proliferation rates (16%) than A-1 expressed in EXPI293™ cells (32%) suggesting that the expression cell line and associated N72-linked glycan composition changes may have an impact on the putative off-target activity observed in the EPISCREEN™ assay. Unexpectedly, all variants of antibody A-1 lacking the N72-linked glycosylation site in the antibody light chain showed much higher T-cell proliferation rates. The results suggest that the composition of the N72-linked Fab glycan may play a role in modulating the off-target T-cell proliferation activity, but that removal of the N72-linked Fab glycan potentiates the off-target activity.

TABLE 37

EpiScreen™ results for 7 ExpiCHO™ expressed anti-gp120 Abs tested on PBMCs from 50 donors.

| Name | Lot # | Expression Cell Line | $^3$H-thymidine incorporation (%) | IL2 Release (%) | $^3$H + IL2 (%) |
|---|---|---|---|---|---|
| A-1 | 6 | ExpiCHO™ | 16 | 6 | 4 |
| 1.1.10-1 | 2 | ExpiCHO™ | 32 | 6 | 6 |

TABLE 37-continued

EpiScreen™ results for 7 ExpiCHO™ expressed anti-gp120 Abs tested on PBMCs from 50 donors.

| Name | Lot # | Expression Cell Line | $^3$H-thymidine incorporation (%) | IL2 Release (%) | $^3$H + IL2 (%) |
|---|---|---|---|---|---|
| 1.1.42-1 | 2 | ExpiCHO™ | 60 | 10 | 10 |
| 1.33.32-1 | 3 | ExpiCHO™ | 60 | 8 | 8 |
| 1.1.54-1 | 2 | ExpiCHO™ | 50 | 14 | 12 |
| 1.37.51-1 | 2 | ExpiCHO™ | 56 | 16 | 10 |
| 1.8.52-1 | 2 | ExpiCHO™ | 6 | 14 | 4 |
| A33 | NA | NA | 16 | 6 | 2 |
| KLH | NA | NA | 14 | 10 | 2 |

Response rates (%) indicate the percent of 50 donors showing responses in the indicated assays.

Since the EPISCREEN™ assay measures $^3$H-thymidine incorporation in primary PBMC cultures, it is possible that in the absence of IL2-release, the off-target activities observed for A-1 and variants thereof could involve proliferation of any cell type present in the PBMCs (e.g., B-cell proliferation instead of T-cell proliferation). To determine if EXPICHO™ derived A-1 and a variant thereof lacking the N72-glycan were stimulating proliferation of T-cells, we next conducted an EPISCREEN™ assay using either CD8+ T-cell depleted PBMCs or CD8+ and CD4+ T-cell depleted PBMCs taken from the same 10 donors. For a negative control, we selected EXPI293™ derived antibody L, which had previously shown low donor response rates in the EPISCREEN™ assay (see, e.g., WO 2017/106346). The results of this assay are shown in Table 38. The results clearly show that $^3$H-thymidine incorporation rates are reduced in the absence of CD4+ T-cells. This data shows that the off-target activity observed for A-1 and variants thereof is dependent on the presence of T-cells. As HIV infects and establishes a latent reservoir in T-cells, off-target anti-gp120 antibody induced T-cell proliferation could potentially expand the HIV-1 reservoir, and would thus be undesirable as part of an HIV cure strategy intended to deplete the HIV-1 reservoir.

TABLE 38

EpiScreen ™ results for 3 anti-gp120 Abs tested on PBMCs from 10 donors in the presence (+CD4) or absence (−CD4) of CD4+ T-cells.

| Name | Lot # | Expression Cell Line | $^3$H-thymidine incorporation +CD4 (%) | $^3$H-thymidine incorporation −CD4 (%) |
|---|---|---|---|---|
| A-1 | 6 | ExpiCHO ™ | 40 | 0 |
| 1.1.54-1 | 2 | ExpiCHO ™ | 40 | 10 |
| L | 3 | Expi293 ™ | 0 | 0 |

Response rates (%) indicate the percent of 10 donors showing responses in the indicated assays.

As described later in Example 15, the molecular composition of the A-1 N72-linked light chain glycan and resulting pharmacokinetics can change dramatically depending on the expression host and resulting sialylation content of the light chain N72-linked Fab glycan. Based on the results of the EPISCREEN™ assays reported in Tables 35 to 38, we hypothesized that the molecular composition of the A-1 N72-linked light chain glycan might impact the observed off-target T-cell proliferation activity described herein. To test this idea, we next conducted a 10 donor EPISCREEN™ assay measuring T-cell proliferation using either EXPICHO™ or CHO-S derived A-1 or variants thereof. As described in Examples 14 and 15, CHO-S derived A-1 has significantly higher N72-glycan sialylation content than EXPI293™ or EXPICHO™ derived material. The results of this EPISCREEN™ assay are shown in Table 39. Antibodies A-1 and 1.1.90-1 expressed in the CHO-S cell line showed no off-target T-cell proliferation. Although the number of donors in this screen was small, this data suggested that the A-1 expression cell line and associated N72-linked light chain glycan composition could modulate not just pharmacokinetics, but also modulate the observed off-target activity in the EPISCREEN™ assay.

TABLE 39

EpiScreen ™ T-cell proliferation results for 6 ExpiCHO ™ or CHO-S expressed anti-gp120 Abs tested on PBMCs from 10 donors.

| Name | Lot # | Expression Cell Line | $^3$H-thymidine incorporation (%) |
|---|---|---|---|
| 1.1.54-1 | 6 | ExpiCHO ™ | 40 |
| L-1 | 2 | CHO-S | 20 |
| 1.1.111-1 | 2 | CHO-S | 30 |
| 1.1.90-1 | 3 | CHO-S | 0 |
| B-1 | 2 | CHO-S | 20 |
| A-1 | 18 | CHO-S | 0 |
| Exenatide | NA | NA | 40 |
| KLH | NA | NA | 60 |

Response rates (%) indicate the percent of 50 donors showing responses in the indicated assays.

Based on the preliminary results shown in Table 39, we next conducted a 50 donor EPISCREEN™ on a panel of 7 anti-gp120 antibodies including A-1 and variants thereof expressed in EXPICHO™ or CHO-S cell lines. The results of this screen are shown in Table 40 and show that A-1 demonstrates very low T-cell proliferation and IL2 release when generated using CHO-S cell lines that incorporate a high level of sialic acid into the N72-linked light chain glycosylation site (see examples 14-15). The results further demonstrate that selected variants of A-1 have further reduced T-cell proliferation rates when produced and tested in the same manner.

TABLE 40

EpiScreen ™ results for 7 anti-gp120 Abs tested on PBMCs from 50 donors.

| Name | Lot # | Expression Cell Line | $^3$H-thymidine incorporation (%) | IL2 Release (%) | $^3$H + IL2 (%) |
|---|---|---|---|---|---|
| 1.1.64-1 | 5 | CHO-S | 36 | 6 | 2 |
| A-1 | 27 | CHO-S | 10 | 0 | 0 |
| 1.52.64-1 | 3 | CHO-S | 4 | 4 | 0 |
| 3.1.5-1 | 3 | CHO-S | 28 | 6 | 4 |
| 2.3.5-1 | 3 | CHO-S | 28 | 2 | 0 |
| 1.1.10-1 | 3 | ExpiCHO ™ | 22 | 10 | 4 |
| L-1 | 7 | CHO-S | 12 | 4 | 2 |
| Exenatide | NA | NA | 38 | 20 | 10 |
| KLH | NA | NA | 98 | 94 | 92 |

Response rates (%) indicate the percent of 50 donors showing responses in the indicated assays.

Example 12: In Vitro Binding Assays

The pharmacokinetics (PK) and pharmacodynamics (PD) of antibody therapeutics is mediated by specific binding to target proteins via the variable domains and/or by binding to Fc-gamma receptors (FcγR) on innate immune cells, neonatal Fc-receptor (FcRn) on endothelial cells and circulating complement protein C1q (Nimmerjahn and Ravetch. 2008. Nat. Rev. Immunol. 8:34-47, Rogers et al. 2014. Immunol. Res. 59:203-210, Kuo T T and Aveson V G. 2011. MAbs 3:422-430). Genetic engineering of the antibody variable domain or Fc domain can impact binding to these receptors and influence PK and PD. We thus assessed the relative affinity of selected antibodies described herein using a variety of common in vitro binding assays including surface plasmon resonance (SPR) and enzyme linked immunosorbent assay (ELISA).

The in vitro binding dissociation constants (KD) of selected antibodies described herein for human and cynomolgus macaque (cyno) Fc binding receptors (FcγRs, FcRn) were determined using the Biacore 4000 surface plasmon resonace (SPR) biosensor, and either C1 or CM4 sensor chips (GE Healthcare). Biotinylated human FcRn was purchased from Immunitrack. Biotinylated cynomolgus macaque FcRn and human FcγRIIIB-NA1 and FcγRIIIB-NA2 were purchased from Acro Biosystems. Human FcγRIIA-167H, FcγRIIA-167R, FcγRIIIA-176F, FcγRIIIA-176V, FcγRIIB/C, FcγRI, and cynomolgus macaque FcγRI, FcγRIIA, FcγRIIB and FcγRIII were purchased from R&D systems.

For human FcRn binding assays, 600 RU of streptavidin was amine coupled to a C1 sensor chip using standard NHS/EDC coupling. The immobilization buffer was PBS+ 0.005% Tween 20, pH 7.4. Streptavidin was prepared at 50 μg/ml in 10 mM NaAc pH 4.5. Activation, coupling, and blocking steps were run for 10 minutes, each at 10 μl/min. Biotinylated human FcRn was captured to about 20 relative units (RU). mAb samples A-1, A and 1.52.64-1 were tested for binding to the FcRn surface using a two-fold concentration series up to 1 μM. Data were collected at pH 6.0 and pH 7.4 in triplicate. The response data at steady-state were fit to a simple binding isotherm.

Human FcγRIIA and FcγRIIIA were amine coupled at 4 different densities (about 100 RU, about 250 RU, about 375 RU and about 725 RU) on a CM4 sensor chip. The three mAb samples were tested for binding in PBS pH 7.4+Tween20 (0.005%) running buffer in a 2-fold dilution series up to 1 μM. Each mAb concentration series was tested twice over each of the 4 receptor densities surfaces generating 8 data sets for each interaction. The response data at steady-state were fit to a simple binding isotherm.

Human FcRIIB/C was amine coupled to a CM4 sensor chip at three different levels (50, 400 and 800 RU). The three mAbs were tested using 2 μM as the highest concentration in a two-fold dilution series. The concentration series was run in triplicate for each antibody across the low, medium and high density receptor surfaces. The response data at steady-state were fit to a simple binding isotherm.

To determine human FcγRIIIB binding affinities, each test antibody was amine coupled to a CM4 sensor chip at two densities (about 100 RU and about 800 RU). Human FcγRIIIB samples were tested for binding using a two-fold concentration series up to 0.5 μM. The response data at steady-state were fit to a simple binding isotherm.

To determine human FcγRI binding affinities, each test antibody was amine coupled to a CM4 sensor chip at two densities (about 100 RU and about 800 RU). Human FcγRI was tested for binding using a two-step titration series (3 nM and 30 nM). Responses were fit to a simple kinetic model.

To determine cynomolgus macaque FcRn binding affinities, 600 RU of streptavidin was amine coupled to a C1 sensor chip using standard NHS/EDC coupling. The immobilization buffer was PBS+0.005% Tween 20, pH 7.4. Streptavidin was prepared at 50 μg/ml in 10 mM NaAc pH 4.5. Activation, coupling, and blocking steps were run for 10 minutes, each at 10 μl/min. Biotinylated cyno FcRn was captured to about 20 RU. Antibodies were tested for binding to the FcRn surface using a two-fold concentration series up to 1 μM. Data were collected at pH 6.0 and pH 7.4 in triplicate. The response data at steady-state were fit to a simple binding isotherm.

To determine cynomolgus macaque FcγRIIA, FcγRIIB, FcγRIII and FcγRI binding affinities each test antibody was amine coupled to a CM4 sensor chip at two densities (about 100 RU and about 800 RU). Cyno FcγRIIA and FcγRIIB were tested in a two-fold concentration series up to 1 μM. FcγRIII was tested in a two-fold concentration up to 500 nM. Cyno FcγRI was tested for binding using a two-step titration (3 nM and 30 nM). The response data for FcγRIIA, FcγRIIB, FcγRIII at steady-state were fit to a simple binding isotherm. Responses for FcγRI were fit to a simple kinetic model.

The full set of binding constants determined by surface plasmon resonance (SPR) are shown in Table 41. The data shows that variants of antibody A with genetically engineered Fc domains have enhanced binding affinity to both human and cyno FcγR and FcRn proteins.

TABLE 41

| Fc Receptor Binding Constants (KD) Determined by SPR | | | |
|---|---|---|---|
| Fc receptor type-allele | A | A-1 | 1.52.64-1 |
| Human FcγRI | 0.107 ± 0.040 nM | 0.002 ± 0.002 nM | 0.0012 ± 0.0005 nM |
| Cyno FcγRI | 0.038 ± 0.016 nM | 0.005 ± 0.004 nM | 0.005 ± 0.003 nM |
| Human FcγRIIA-167H | 1.8 ± 0.5 μM | 131 ± 22 nM | 221 ± 21 nM |
| Human FcγRIIA-167R | 3 ± 1 μM | 130 ± 9 nM | 199 ± 21 nM |
| Cyno FcγRIIA | 2000 ± 1000 nM | 1100 ± 80 nM | 1180 ± 60 nM |
| Human FcγRIIB | 11 ± 0.8 μM | 1.6 ± 0.2 μM | 1.9 ± 0.2 μM |
| Cyno FcγRIIB | 895 ± 50 nM | 240 ± 9 nM | 280 ± 32 nM |
| Human FcγRIIIA - 176V | 670 ± 40 nM | 59 ± 4 nM | 67 ± 6 nM |
| Human FcγRIIIA - 176F | 2.3 ± 0.6 μM | 52 ± 4 nM | 63 ± 5 nM |
| Human FcγRIIIB - NA1 | 2000 ± 1000 nM | 59 ± 9 nM | 64 ± 15 nM |
| Human FcγRIIIB - NA2 | 1500 ± 400 nM | 56 ± 18 nM | 55 ± 14 nM |
| Cyno FcγRIII | 200 ± 70 nM | 7.1 ± 0.7 nM | 8 ± 2 nM |
| Human FcRn pH 7.4 | 42 ± 1 μM | 1.7 ± 0.3 μM | 1.12 ± 0.08 μM |
| Human FcRn pH 6.0 | 485 ± 43 nM | 38 ± 3 nM | 49 ± 5 nM |
| Cyno FcRn pH 7.4 | 12.8 ± 0.4 μM | 4.3 ± 0.4 μM | 5.3 ± 0.2 μM |
| Cyno FcRn pH 6.0 | 1100 ± 100 nM | 16 ± 2 nM | 22 ± 2 nM |

A dose response binding ELISA was conducted to determine the relative C1q binding affinity of antibodies described herein. To conduct they assay, a 384-well Maxisorp plate was coated with 25 μl of antibody solution at 5 μg/mL in PBS pH 7.4 overnight at 4° C. Plates were then blocked with 75 μL of 1% BSA in PBS for 2 hours and washed 4 times with PBS+0.05% Tween 20 (PBST). Next, 25 μL of a three-fold serial dilution of human C1q protein in PBS+5% BSA was added to the plates. Plates were incubated with shaking at 600 rpm for one hour, washed 4 times with PBST and then 25 μL of anti-C1q-HRP conjugated polyclonal antibody was added in PBS+5% BSA. Plates were incubated with shaking at 600 rpm for 15 minutes, washed 8 times with PBST and then developed using 3,3',5,5'-Tetramethylbenzidine (TMB) substrate and quenched with HCl. Absorbance at 450 nM was read using a spectramax m5 plate-reader and EC50 values were determined using a 4-parameter dose response fit.

The average EC50 values for the C1q binding ELISA were calculated from three independent assays and are shown in Table 42.

TABLE 42

| C1q Binding EC50 values Determined by ELISA (n = 3 assays) | |
|---|---|
| Antibody | C1q Binding EC50 (nM) |
| A | 2.2 ± 1.2 nM |
| A-1 | >100 nM |
| 1.52.64-1 | >100 nM |

The results show that Fc engineered variants of antibody A have significantly reduced C1q binding affinity.

A dose response binding ELISA was conducted to determine the relative gp120 binding affinities of the antibodies described herein. To conduct the assay, a 384 well Maxisorp plate was coated with 25 µl of 5 µg/ml gp120 and incubated overnight at 4° C. The plate was washed 4 times with PBS 0.05% Tween 20 and blocked with 75 µl of PBS 5% BSA for 1 hr at room temperature while shaking at 600 rpm. After blocking, the wells were aspirated and 25 µL of a 3-fold serial dilution of primary antibody was added and incubated at room temperature for 1 hr with shaking at 600 rpm. The plate was then washed 4 times with PBS 0.05% Tween 20 and 25 µl of goat anti-human IgG (H+L) HRP secondary antibody diluted 1/10,000 in PBS 1% BSA was added and incubated at room temperature, shaking at 600 rpm for 30 mins. Next, the plate was washed 4 times with PBS 0.05% Tween 20 and 25 µl fresh TMB substrate was added. The plate was developed for 90 secs with shaking at 600 rpm and before being quenched with 25 µl 1M HCl. The absorbance was read at A450 on a Spectramax m5 plate reader.

The average EC50 values were calculated from three independent ELISA assays and are shown in Table 43.

TABLE 43

| gp120 binding EC50 values determined by ELISA | | | |
|---|---|---|---|
| gp120 protein | A | A-1 | 1.52.64-1 |
| Bal | 0.05 ± 0.02 nM | 0.06 ± 0.01 nM | 0.07 ± 0.02 nM |
| CAAN | 1.84 ± 0.22 nM | 2.17 ± 0.56 nM | 3.79 ± 1.26 nM |
| REJO | 2.21 ± 0.44 nM | 2.37 ± 0.68 nM | 4.02 ± 0.45 nM |

The results suggest that all antibodies tested bind HIV gp120 protein with similar affinities.

Example 13: Effects of Fc Mutations on Serum Half-Life

In this example, IgG1 Fc mutations that enhance effector cell killing and/or that enhance FcRn binding were evaluated for effects on serum half-life. The data are consistent with the conclusion that mutations in the IgG1 Fc that enhance effector cell killing activity (e.g., aspartic acid at position 239, glutamic acid at position 332, alanine at position 236, leucine at position 330 according to EU number (DEAL)) can shorten serum half-life in vivo. Such shortened serum half-life can be partially or wholly recovered by also incorporating mutations in the IgG1 Fc that enhance FcRn binding (e.g., leucine at position 428, and serine at position 434 according to EU numbering (LS)).

PGT121-WT, PGT121-DEAL, PGT121.60, PGT121-LS (described, e.g., in WO 2017/106346), and A-1 from the present application were administered to cynomologus macaque monkeys (Covance, TX) at 10 mg/kg or 0.5 mg/kg (A-1) via a single intravenous (IV) injection to characterize their basic pharmacokinetic (PK) profiles. Serum samples collected from monkeys were analyzed using a bioanalytical method of sufficient selectivity and sensitivity to determine serum concentration-time profiles and calculate the mean serum PK parameters by non-compartmental PK analysis (NCA). The bioanalytical method utilized clade B gp120 antigen (Immune-tech, CA) as a capture reagent and biotin conjugated goat anti-human IgG antibody (Southern Biotech, AL) as a secondary reagent, with SULFO-TAG labeled Streptavidin (MesoScale Discovery, MD) for electrochemical detection.

Figure 6:
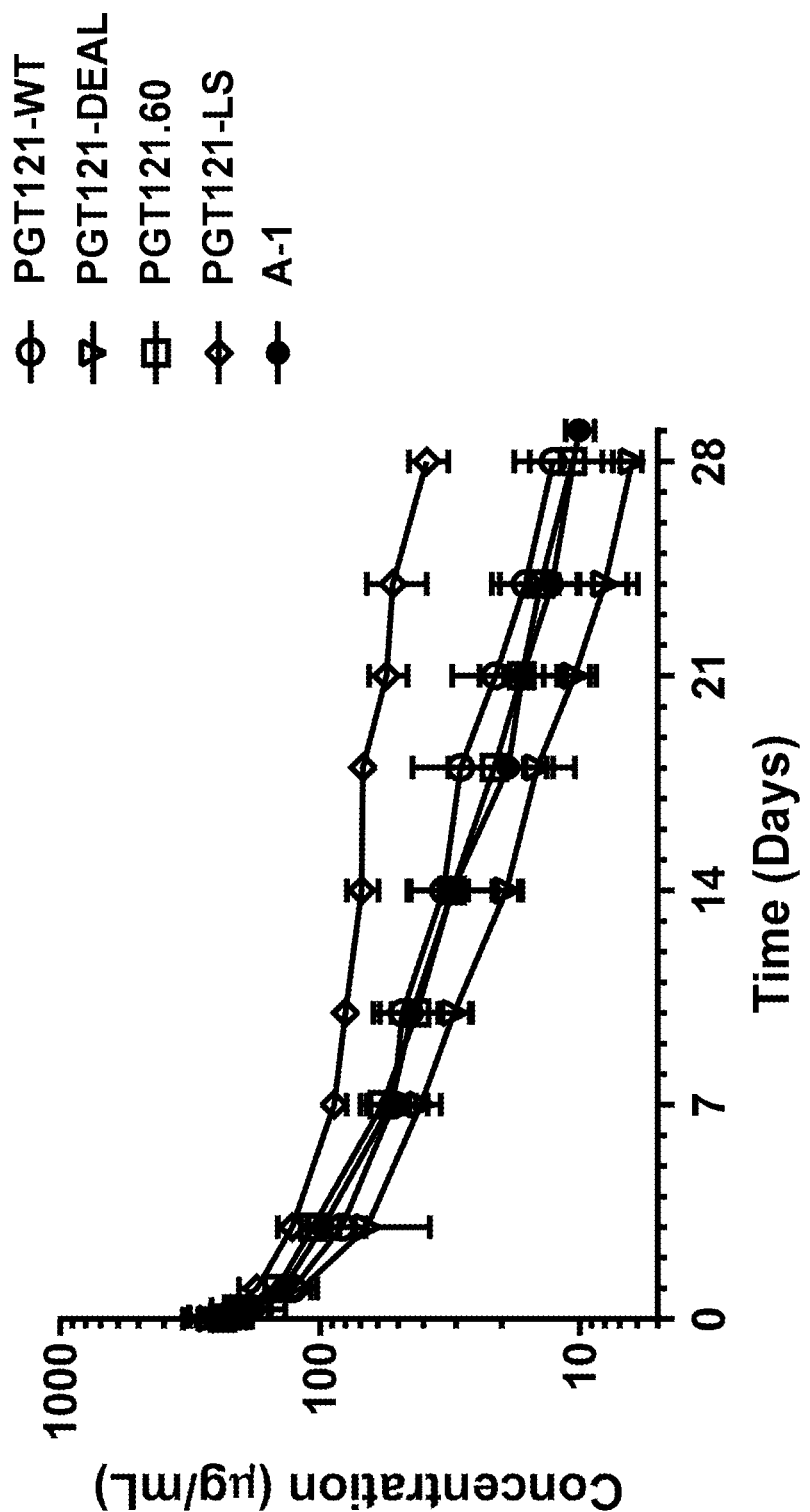
FIG. 6 illustrates that mutations in the IgG1 Fc that enhance effector cell killing activity (e.g., aspartic acid at position 239, glutamic acid at position 332, alanine at position 236, leucine at position 330 according to EU number (DEAL)) can shorten serum half-life in vivo. Such shortened serum half-life can be partially or wholly reversed by also incorporating mutations in the IgG1 Fc that enhance FcRn binding (e.g., leucine at position 428, and serine at position 434 according to EU numbering (LS)). Depicted are illustrative dose normalized pharmacokinetic profiles for PGT121-WT (circle), PGT121-DEAL (triangle), PGT121.60 (square), PGT121-LS (diamond), and A-1 (solid circle) dosed IV to naïve cynomologus monkeys (n=3). Each symbol is the measured mean (±SD) serum concentration.

The measured serum concentration versus time profiles of PGT121-WT, PGT121-DEAL, PGT121.60, PGT121-LS, and A-1, depicted in FIG. 6, were used the calculate the mean (±SD) PK parameters depicted in Table 44.

TABLE 44

Pharmacokinetic parameters of PGT121-WT, PGT121-DEAL, PGT121.60, PGT121-LS, and A-1 after IV administration in naive cynomolgus monkeys (n = 3).

| Test Article | Dose (mg/kg IV) | $AUC_{0-\infty}$ (day*ug/mL) | Cl (mL/day/kg) | $V_d$ (mL/kg) | $t_{1/2}$ (day) |
|---|---|---|---|---|---|
| PGT121-WT | 10 | 1510 ± 470 | 7.0 ± 1.9 | 105 ± 17.6 | 10.6 ± 1.3 |
| PGT121-DEAL | 10 | 1020 ± 167 | 9.9 ± 1.5 | 109 ± 20 | 7.7 ± 1.3 |
| PGT121.60 | 10 | 1490 ± 377 | 7.0 ± 1.9 | 96 ± 19 | 9.7 ± 0.8 |
| PGT121-LS | 10 | 3540 ± 463 | 2.9 ± 0.4 | 82 ± 11 | 19.9 ± 2.1 |
| A-1 | 0.5 | 70 ± 7.0 | 7.2 ± 0.7 | 91 ± 14 | 8.7 ± 0.8 |

The PK analysis showed that inclusion of the Fc mutations (DEAL) to PGT121-WT negatively impacted the PK by increasing the clearance (Cl) to 9.9±1.5 mL/day/kg for PGT121-DEAL relative to 7.0±1.9 mL/day/kg for PGT121-WT and reduced the half-life (t½) to 7.7±1.3 days versus 10.6±1.3 days for PGT121-WT. Inclusion of the FcRn binding mutations (LS) to antibodies with an Fc that contains the DEAL mutations (PGT121.60 and A-1), resulted in Cl values of 7.0±1.9 and 7.2±0.7 mL/day/kg and t½ values of 9.7±0.8 and 8.7±0.8 days, respectively, which are comparable to the PK of PGT121-WT. While inclusion of LS alone to PGT121-WT reduced the Cl to 2.9±0.4 mL/day/kg and increased the t½ to 19.9±2.1 days for PGT121-LS. The PK analysis support that introduction of the Fc-enhancing mutations DEAL reduces antibody PK (likely due to enhanced FcgR binding), which can be recovered by inclusion of the LS FcRn binding mutations.

Example 14. Light Chain Fab Glycan Profile Assessments

Two techniques were used to isolate and analyze the light chain Fab glycan profiles in the absence of potentially interfering heavy chain Fc glycans. The primary goal of these experiments was to understand the relative percentage of light chain glycans terminating with one or more sialic acid groups (referred to as percent sialylation hereafter). The first approach ("method 1") was reverse phase mass spectrometry of the reduced, intact light chain. In this technique, observed mass shifts in the deconvoluted mass spectrum are assigned to the glycan structure known from biosynthetic N-glycan pathways to correspond to the mass shift. Relative quantification of the sialylated forms is obtained by summing the deconvoluted peak heights for the sialylated species and dividing this value by the total of all sialylated and non-sialylated peak heights. A second method ("method 2") to quantify the sialylation on the light chain fab glycans relied on selective enzymatic release of the Fc glycans (under purely aqueous conditions) prior to isolations of the remaining protein and release of the remaining light chain Fab glycans. The separate aliquots corresponding to the Fc and Fab glycans are then fluorescently labeled (Waters RapiFluor) and analyzed, identified, and quantified by HILIC chromatography. The percent Fab sialylation values for multiple antibodies described herein and analyzed by one of these techniques are shown below in Tables 45A and 45B.

TABLE 45A

Light chain Fab glycan assessment of antibody A-1

| | Lot | | |
|---|---|---|---|
| | 14 | 10 | 7 |
| | Expression System | | |
| Glycan ID[1] | CHO-S % Peak Area | Tuna293 ™ % Peak Area | ExpiCHO ™ % Peak Area |
| Unknown Peaks[2] | 6.47 | 3.50 | 4.16 |
| G0-GlcNAc | 0.00 | 4.20 | 4.49 |
| G0 | 0.91 | 55.97 | 52.43 |
| G0F | 0.00 | 1.25 | 1.52 |
| G1F-GlcNAc | 0.00 | 11.77 | 0.00 |
| Man5 | 0.88 | 4.02 | 0.00 |
| G1(a) | 0.44 | 6.50 | 9.54 |
| G1(b) | 0.46 | 0.43 | 6.92 |
| G1-GlcNAc | 0.00 | 0.00 | 11.17 |
| G1F(a) | 0.27 | 0.00 | 0.00 |
| G1F(b) | 0.00 | 0.00 | 0.31 |
| G1S | 0.00 | 1.88 | 0.87 |
| G2 | 0.00 | 7.42 | 8.59 |
| G2F | 6.14 | 0.00 | 0.00 |
| G2S(a) | 0.28 | 1.79 | 0.00 |
| G2S(b) | 38.65 | 1.30 | 0.00 |
| G2FS | 0.67 | 0.00 | 0.00 |
| G2S2 | 39.13 | 0.00 | 0.00 |
| G2FS2 | 0.69 | 0.00 | 0.00 |
| G2S + 2 GlcNAc | 2.60 | 0.00 | 0.00 |
| G2S2 + 2GlcNAc(a) | 0.82 | 0.00 | 0.00 |
| G2S2 + 2GlcNAc(b) | 1.60 | 0.00 | 0.00 |
| Sum Sialylated Glycans[3] | 84.44 | 4.97 | 0.87 |

[1]Identification and peak percentages derived from selective fab glycan (VL) release, labeling, and hydrophilic interaction liquid chromatography (HILIC) method. All identification are based on observed monoisotopic masses and known biosynthetic pathways, however isomeric variants are possible for some entries.
[2]Unknown, system, and reagent peak totals.
[3]Sum of sialylated glycans; sum of identified N-glycans terminating in one or more sialic acid (N-acetylneuraminic acid) residues (underlined).

TABLE 45B

Light chain Fab glycan assessement comparing Antibodies A-1 and 1.52.64-1

| Name | Lot # | Cell Line | Percent Sialylation | Method |
|---|---|---|---|---|
| A-1 | 5 | Expi293 ™ | 67/52 | 1/2 |
| | 7 | ExpiCHO ™ | 1/1 | 1/2 |
| | 10 | Tuna293 ™ | 5 | 2 |
| | 14 | CHO-S | 84 | 2 |
| | 22 | CHO-origin | 73 | 1 |
| 1.52.64-1 | 18-PP21 | CHO-origin | 49 | 1 |
| | 14525-02 | CHO-origin | 83 | 1 |

[1]Reduced Light Chain LC/MS
[2]Selective Fab Glycan Release, Labeling, and HILIC Chromatography Example 15: Effects of Fv Mutations and Fv-Glycosylation Profiles on Antibody Pharmacokinetics Antibody A and several engineered antibodies described herein were administered to cynomolgus macaque monkeys to characterize their pharmacokinetic (PK) profiles. In certain cases, Antibody A-1 variants were transiently or stably produced in different expression cell lines to assess the impact of N72-linked Fab glycan sialylation on PK. Percent Fab glycan sialylation was determined using LCMS as described in Example 14. Serum samples collected from monkeys were analyzed using a bioanalytical method of sufficient selectivity and sensitivity to determine serum concentration-time profiles and mean serum PK parameters by non-compartmental PK analysis (NCA). The bioanalytical method utilized clade B gp120 antigen (Immune-tech, CA) as a capture reagent and biotin conjugated goat anti-human IgG antibody (Southern Biotech, AL) as a secondary reagent, with SULFO-TAG labeled Streptavidin (MesoScale Discovery, MD) for electrochemical detection.

Figure 7:
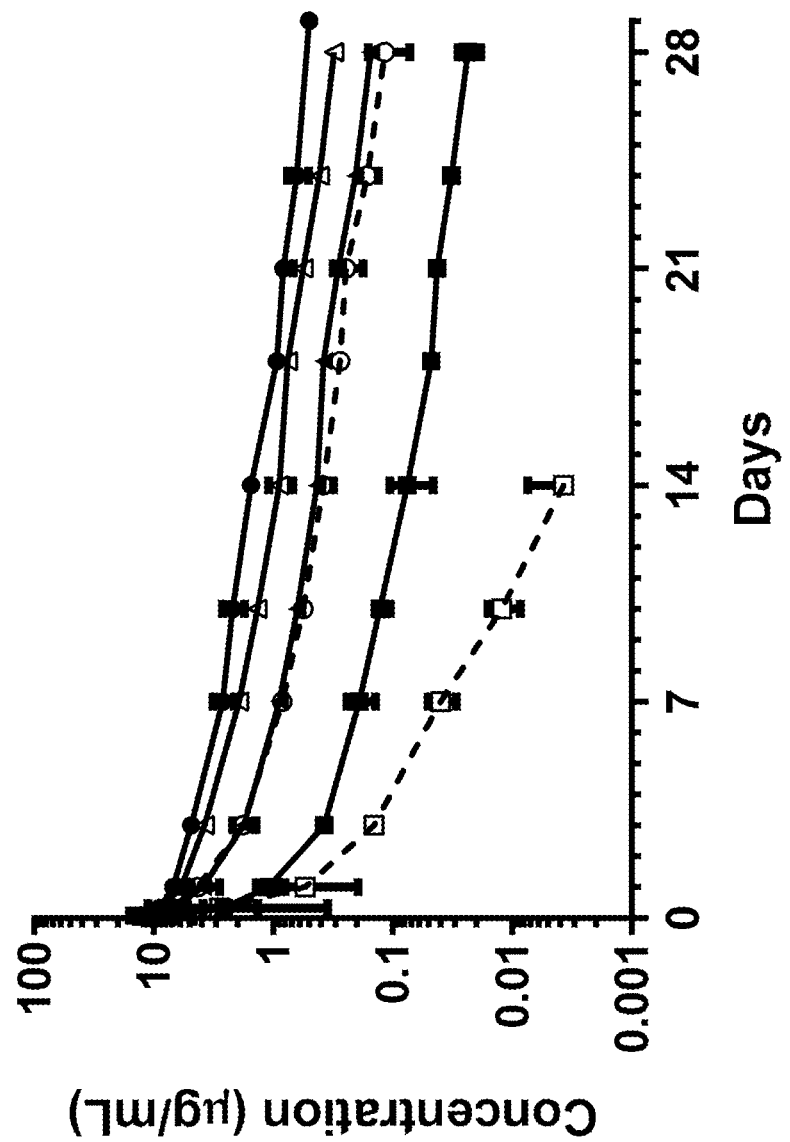
FIG. 7 illustrates pharmacokinetic profiles for Antibody A (triangle), Antibody A-1 Lot 14 (circle), Antibody A-1 Lot 22 (open triangle), Antibody A-1 Lot 3 (open circle), Antibody A-1 Lot 10 (square), and Antibody A-1 Lot 7 (open square) following intravenous (IV) dosing to naïve male cynomolgus monkeys (n=3). Each symbol is the measured mean (±SD) serum concentration.

The in vivo disposition of Antibody A and several engineered variants transiently expressed in different cell lines was characterized after a single intravenous (IV) administration in three (n=3) naïve male cynomolgus monkeys per group (Covance, TX). The measured mean±standard deviation (SD) serum concentration-time profiles is depicted in FIG. 7. The pharmacokinetic analysis of Antibody A transiently expressed in EXPI293™ (ThermoFisher Scientific, MA) dosed at 0.5 mg/kg IV showed clearance (C1) values of 17.9±1.0 and corresponding half-life (t½) of 8.9±1.7 days which were comparable to Antibody A-1 Lot 3, expressed in EXPI293™ under similar conditions, with a C1 of 18.7±2.3 mL/day/kg and t½ of 7.6±0.3 days (Table 46).

Antibodies with variable domain Fab glycans containing low sialic acid or high mannose may have altered PK (Liu L. 2015. J. Pharm. Sci. 104:1866-1884). Glycan compositions can be altered as a result of protein expression conditions, therefore the in vivo disposition of A-1 was evaluated using additional transiently expressed lots characterized for their % Fab glycan sialylation content, namely CHO-S (Lot 14), CHO-origin (Lot 22) (Sigma-Aldrich, MO), and TUNA293™ (Lot 10) (LakePharma, CA), and EXPICHO™ (Lot 7) (ThermoFisher Scientific, MA). Antibodies were characterized after a single IV dose of 0.5 mg/kg (Lot 14, 22, and 10) or 5.0 mg/kg (Lot 7) in naïve male cynomolgus monkeys (Covance, TX). The measured mean (±SD) serum concentration-time profiles of each lot of Antibody A-1 are depicted in FIG. 7. Lot 7 was dose normalized for direct comparison. The pharmacokinetic analysis of the tested Antibody A-1 lots showed variable PK based on % Fab sialylation content (Table 46). Antibody A-1 Lot 14 with 84% Fab glycan sialylation had the lowest clearance (C1) value of 7.2±0.7 mL/day/kg, while the C1 was progressively faster with Antibody A-1 Lot 22 (73%) with a C1 of 10.7±1.7, Antibody A-1 Lot 3 with a C1 of 18.7±2.3 mL/day/kg, Antibody A-1 Lot 10 (5%) with a C1 of 68.7±19.8 mL/day/kg, and Antibody A-1 Lot 7 (<1%) with a C1 of 120±46.7 mL/day/kg. The data supports protein expression conditions can impact Fab glycan composition and resultant PK.

TABLE 46

Pharmacokinetics of antibody A and several engineered variants after IV administration in naïve male cynomolgus monkeys (n = 3).

| Test Article | Expression System | Lot | IV Dose (mg/kg) | Cl (mL/day/kg) | % Fab Sialylation |
|---|---|---|---|---|---|
| A | Expi293 ™ | 5 | 0.5 | 17.9 ± 1.0 | ND |
| A-1 | Expi293 ™ | 3 | 0.5 | 18.7 ± 2.3 | ND |
| A-1 | CHO-S | 14 | 0.5 | 7.2 ± 0.7 | 84 |
| A-1 | CHO-origin | 22 | 0.5 | 10.7 ± 1.7 | 73 |
| A-1 | Tuna293 ™ | 10 | 0.5 | 68.7 ± 20 | 5 |
| A-1 | ExpiCHO ™ | 7 | 5 | 120 ± 47 | <1 |
| 1.1.54-1 | ExpiCHO ™ | 3 | 5 | 12 ± 1 | ND |
| 1.37.51-1 | ExpiCHO ™ | 3 | 5 | 15 ± 12 | ND |

ND = not determined

To evaluate the impact of protein modifications aimed to remove the variable domain N72-linked glycan and polyspecificity, in vivo PK of 1.1.54-1 and 1.37.51-1 (two antibodies without the N72-linked glycan removed) was evaluated. Both antibodies were transiently expressed in the EXPICHO™ mammalian cell expression system under similar conditions which resulted in reduced PK of A-1 (Lot 7, above). Antibodies were characterized after a single IV bolus dose of 5 mg/kg to three naïve male cynomolgus monkeys (Covance, TX). The PK analysis (Table 46) demonstrated that 1.1.54-1 and 1.37.51-1 were comparable in Cl (12±1 and 15±12 mL/day/kg, respectively), yet significantly improved over A-1 Lot 7 (Cl of 120±47 mL/day/kg), supporting that protein modifications which remove the variable domain N72-linked glycan can improve the PK of the antibody variants described herein. Removing the glycan did not achieve the same clearance as the highly sialylated lots, supporting that the N72-linked glycan may be present to reduce non-specific protein interactions.

Figure 8:
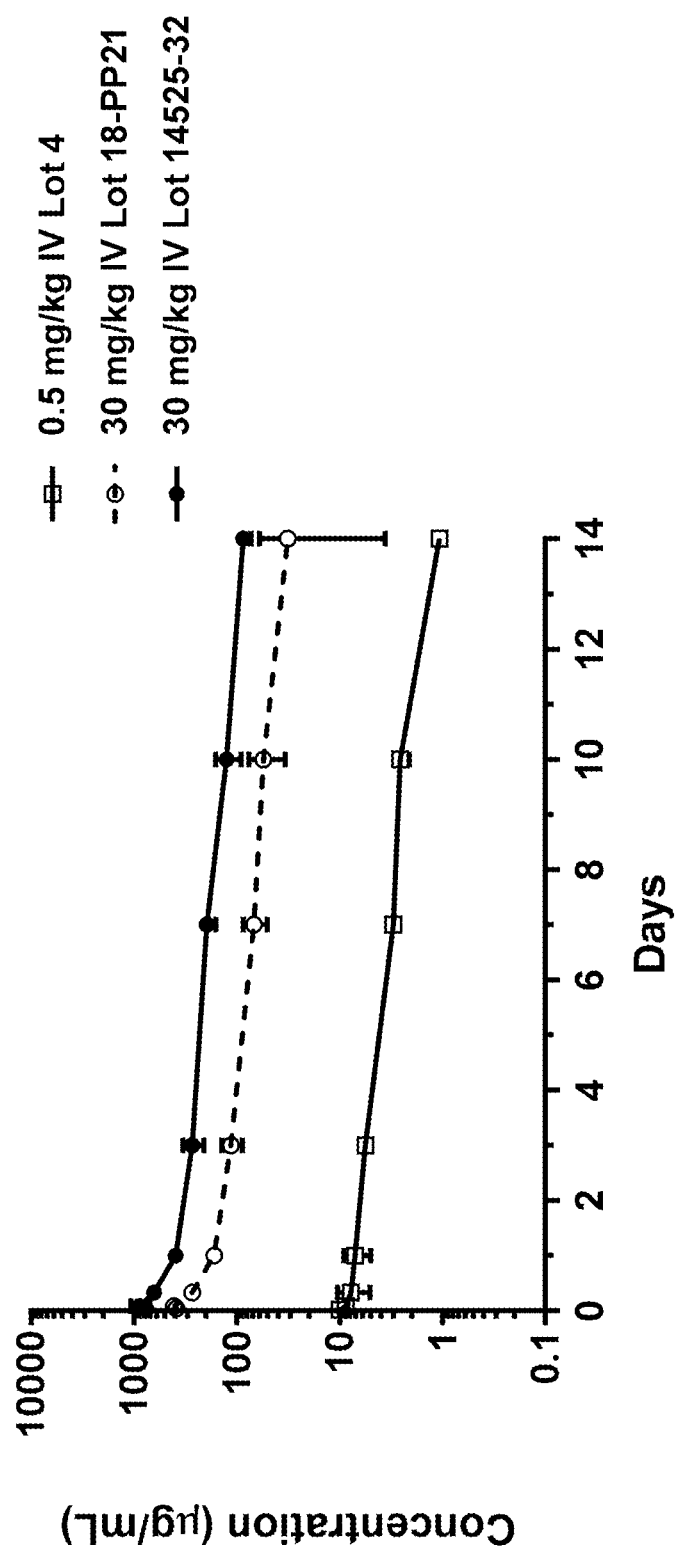
FIG. 8 illustrates mean serum (±SD) concentration-time profiles of three lots of 1.52.64-1 following IV administrations to naïve male and female cynomolgus monkeys (n=3). Lot 4 (open square) was administered at 0.5 mg/k slow IV bolus, while Lot 18-PP21 (open circle) and Lot 14525-32 (circle) were administered at 30 mg/kg via a 30 minute IV infusion. Each symbol is the measured mean (±SD) serum concentration.

The PK of 1.52.64-1 (Lot 4) derived from transient expression in CHO-S, or 1.52.64-1 from a stable pool of CHO-origin cells (Lot 18-PP21) or from a clonally selected CHO-origin cell line (Lot 14525-32) was studied following a single IV administration in naïve male and female cynomolgus monkeys (n=3). The mean±SD serum concentration-time profiles for days 0-14 are presented in FIG. 8. Results of the NCA are depicted in Table 47. 1.52.64-1 (Lot 4) contained approximately 75% Fab sialylation. 1.52.64-1 Lot 4 dosed at 0.5 mg/kg IV slow bolus resulted in a cynomolgus monkey clearance of 7.8±0.6 mL/day/kg; equivalent to A-1 Lot 14 (7.2±0.7 mL/day/kg) expressed in CHO-S under similar conditions.

TABLE 47

Pharmacokinetic parameters of three lots of 1.52.64-1 following IV administrations in naïve male and female cynomolgus monkeys (n = 3).

| Expression system | Lot | IV Dose (mg/kg) | Cl (mL/day/kg) | % Fab Sialylation |
|---|---|---|---|---|
| CHO-S transient tranfection | Lot 4 | 0.5 | 7.8 ± 0.6 | 75 |
| CHO-origin stable pool | Lot 18-PP21 | 30 | 20.8 ± 9.5 | 49 |
| CHO-origin stable clone | Lot 14525-32 | 30 | 7.9 ± 1.3 | 84 |

1.52.64-1 Lot 18-PP21 yielded material with approximately 49% Fab sialylation while Lot 14525-32 yielded material with approximately 84% Fab sialylation from the CHO-origin stable expression system. 1.52.64-1 Lot 18-PP21 and Lot 14525-32 were administered via a 30 minute IV infusion at 30 mg/kg. PK analysis revealed that Lot 18-PP21 had reduced exposure relative to Lot 14525-32 due to the increased clearance of 20.8±9.5 mL/day/kg compared to 7.9±1.3 mL/day/kg, respectively. The increased clearance is consistent with the reduced % Fab glycan sialylation (49% vs 84%). The totality of the preclinical PK assessments demonstrate that antibody A variants containing a Fab glycan structure require controlled protein production conditions to yield antibodies with high Fab glycan sialylation (e.g. ≥75%) that will achieve desirable antibody pharmacokinetics.

Example 16: Selection of High Sialylation Cell Lines

In view of the foregoing data and analyses, we isolated cell lines to produce highly sialylated antibody. To accomplish this, cell line development (CLD) was biased towards identification of cell lines that express highly sialylated anti-gp120 antibodies, as described herein. Briefly, the CHO-based development cell line was transfected with a vector encoding the heavy host and light chains of antibody variants described herein. Multiple stable pools were assessed for bioreactor performance and product quality (including % sialylation). Stable pools expressing antibody having a high level of sialyation (e.g., at least about 75% sialylated) were selected for clone generation. In order to further bias clonal cell line isolation towards higher sialylation, clonal cell lines generated from the parent stable pool with the highest % sialyation (approximately 95% sialylated) were over-represented throughout the clone generation workflow. Multiple clonal cell lines were assessed for bioreactor performance and product quality (including % sialylation) and a clonal cell line expressing highly sialylated antibody (>85%) was selected as the lead cell line for master cell bank (MCB) manufacturing.

OTHER EMBODIMENTS

While the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (653 sequences)

SEQ ID NO: 1 - protein, 455 aa, Artificial Sequence
  Description of Artificial Sequence: Synthetic polypeptide
QVRLSQSGGQMKKPGDSMRISCRASGYEFINCPINWIRLAPGKRPEWMGWMKPRWGAVSYARQLQGRVTMTRDMYSETAFLELRSLTSDDTAVYFCTRGKYCTARDYYNWDFEHWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 3 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4 - protein, 455 aa, Artificial Sequence
  Description of Artificial Sequence: Synthetic polypeptide
QVRLSQSGGQMKKPGDSMRISCRASGYEFINCPINWIRLAPGKRPEWMGWMKPRHGAVSYARQLQGRVTMTRDMYSETAFLELRSLTSDDTAVYFCTRGKYCTARDYYNWDFEHWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 5 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTYSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 6 - protein, 453 aa, Artificial Sequence
  Description of Artificial Sequence: Synthetic polypeptide
QVQLLQSGAEVKKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 7 - protein, 453 aa, Artificial Sequence
  Description of Artificial Sequence: Synthetic polypeptide
QVSLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 8 - protein, 453 aa, Artificial Sequence
  Description of Artificial Sequence: Synthetic polypeptide
QVQLVQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 9 - protein, 453 aa, Artificial Sequence
  Description of Artificial Sequence: Synthetic polypeptide
QVQLVQSGAAVTKPGASVRVSCKASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 10 - protein, 453 aa, Artificial Sequence
  Description of Artificial Sequence: Synthetic polypeptide
QVQLLQSGAEVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 11 - protein, 453 aa, Artificial Sequence
  Description of Artificial Sequence: Synthetic polypeptide
QVQLLQSGAEVKKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 12 - protein, 453 aa, Artificial Sequence
  Description of Artificial Sequence: Synthetic polypeptide
QVQLVQSGAEVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 13 - protein, 453 aa, Artificial Sequence
  Description of Artificial Sequence: Synthetic polypeptide
QVQLVQSGAEVKKPGASVRVSCKASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 14 - protein, 453 aa, Artificial Sequence
  Description of Artificial Sequence: Synthetic polypeptide
QVQLLQSGAAVTKPGASVRVSCEASGYNIRDYFMHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 15 - protein, 453 aa, Artificial Sequence
  Description of Artificial Sequence: Synthetic polypeptide
QVQLLQSGAAVTKPGASVRVSCEASGYNIRDYFMHWWRQAPGQGLQWVGWINPKTGQPNNPRQFQGRVSLTRHASWDFDTFSAYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 16 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKWGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 17 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKGGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 18 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKAGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 19 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKHGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 20 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVTLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 21 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVTMTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 22 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRDASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 23 - protein, 449 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 24 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFSMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 25 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLSRLRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 26 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTATYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 27 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRTDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 28 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTATYFCARQRTDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 29 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 30 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 31 - protein, 453 aa, Artificial Sequence
  Description of Artificial Sequence: Synthetic polypeptide
QVQLLQSGAAVTKPGASVRVSCEASGYNIRDYFIHWVRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 32 - protein, 453 aa, Artificial Sequence
  Description of Artificial Sequence: Synthetic polypeptide
QVQLLQSGAAVTKPGASVRVSCEASGYNIRDYFMHWVRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 33 - protein, 453 aa, Artificial Sequence
  Description of Artificial Sequence: Synthetic polypeptide
QVQLLQSGAAVTKPGASVRVSCEASGYNIRDYFMHWVRQAPGQGLQWVGWINPKTGQPNNPRQFQGRVSLTRHASWDFDTFSAYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 34 - protein, 453 aa, Artificial Sequence
  Description of Artificial Sequence: Synthetic polypeptide
QVQLVQSGAEVTKPGASVRVSCEASGYNIRDYFIHWWRQAPGQGLQWVGWINPKTGQPNNPRQFQGRVSLTRHASWDFDTFSFYMDLKALRSDDTATYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 35 - protein, 453 aa, Artificial Sequence
  Description of Artificial Sequence: Synthetic polypeptide
QVQLVQSGAEVTKPGASVRVSCEASGYNIRDYFIHWWRQAPGQGLQWVGWINPKTGQPNNPRQFQGRVSLTRHASWDFDTFSFYMDLKALRSDDTAVYFCARQRTDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 36 - protein, 453 aa, Artificial Sequence
  Description of Artificial Sequence: Synthetic polypeptide
QVQLVQSGAEVKKPGASVRVSCKASGYNIRDYFIHWWRQAPGQGLQWVGWINPKTGQPNNPRQFQGRVTLTRHASWDFDTFSFYMDLKALRSDDTATYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 37 - protein, 453 aa, Artificial Sequence
  Description of Artificial Sequence: Synthetic polypeptide
QVQLVQSGAEVKKPGASVRVSCKASGYNIRDYFIHWWRQAPGQGLQWVGWINPKTGQPNNPRQFQGRVTLTRHASWDFDTFSFYMDLKALRSDDTAVYFCARQRTDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 38 - protein, 453 aa, Artificial Sequence
  Description of Artificial Sequence: Synthetic polypeptide
QVQLVQSGAEVKKPGASVRVSCKASGYNIRDYFMHWWRQAPGQGLQWVGWINPKTGQPNNPRQFQGRVTMTRHASWDFDTFSFYMDLSRLRSDDTATYFCARQRTDYWDFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 39 - protein, 453 aa, Artificial Sequence
  Description of Artificial Sequence: Synthetic polypeptide
QVQLVQSGAEVKKPGASVRVSCKASGYNIRDYFMHWWRQAPGQGLQWVGWINPKTGQPNNPRQFQGRVTMTRHASWDFDTFSAYMDLSRLRSDDTATYFCARQRTDYWDFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 40 - protein, 453 aa, Artificial Sequence
  Description of Artificial Sequence: Synthetic polypeptide
QVQLVQSGAEVKKPGASVRVSCKASGYNIRDYFIHWWRQAPGQGLQWVGWINPKTGQPNNPRQFQGRVSLTRHASWDFDTYSFYMDLSRLRSDDTAVYFCARQRSDYWDFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 41 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 453 aa, Artificial Sequence
  Description of Artificial Sequence: Synthetic polypeptide
QVHLSQSGAAVTKPGASVRVSCEASGYKISDHFIHWWRQAPGQGLQWVGWINPKTGQPNNPRQFQGRVSLTRQASWDFDTYSFYMDLKAVRSDDTAIYFCARQRSDFWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 43 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 44 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 45 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 46 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLLPPKPKDTLMISRTPEVTCVVVDVSHEDPEVKFNWYVDGVEVHNAKTKPPEEQYNSTLRVVSILTVLHQDWLNGKEYKCKVSNKALPAPIEKTISKAKGQPREPQVYTLPPSREEMTKNQVSLTCLVKGFYPSDIAVEWESNGQPENNYKTTPLVLDSDGSFFLYSKLTVDKSRWQQGNVFSCSVLHEALHSHYTQKSLSLSPGK

SEQ ID NO: 47 - protein, 453 aa, Artificial Sequence
  Description of Artificial Sequence: Synthetic polypeptide
QVQLVQSGAEVKKPGASVRVSCKASGYNIRDYFIHWWRQAPGQGLQWVGWINPKTGQPNNPRQFQGRVSLTRHASWDFDTFSFYMDLKALRSDDTAVYFCARQRSDYWDFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 48 - protein, 210 aa, Artificial Sequence
  Description of Artificial Sequence: Synthetic polypeptide
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 49 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 50 - protein, 208 aa, Artificial Sequence
  Description of Artificial Sequence: Synthetic polypeptide
SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 51 - protein, 206 aa, Artificial Sequence
  Description of Artificial Sequence: Synthetic polypeptide
EIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 52 - protein, 206 aa, Artificial Sequence
  Description of Artificial Sequence: Synthetic polypeptide
DIQMTQSPSSLSASVGDRVTITCQANGYLNWYQQRRGKAPKLLIYDGSKLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 53 - protein, 206 aa, Artificial Sequence
  Description of Artificial Sequence: Synthetic polypeptide
DIQMTQSPSSLSASVGDTVTITCQANGYLNWYQQKPGKAPKLLIYDGSKLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 54 - protein, 206 aa, Artificial Sequence
  Description of Artificial Sequence: Synthetic polypeptide
DIQMTQSPSSLSASVGDTVTITCQANGYLNWYQQRRGKAPKLLIYDASKLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 55 - protein, 206 aa, Artificial Sequence
  Description of Artificial Sequence: Synthetic polypeptide
DIQMTQSPSSLSASVGDTVTITCQANGYLNWYQQRRGKAPKLLIYDGSNLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 56 - protein, 206 aa, Artificial Sequence
  Description of Artificial Sequence: Synthetic polypeptide
DIQMTQSPSSLSASVGDTVTITCQANGYLNWYQQRRGKAPKLLIYDASNLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 57 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLETGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 58 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYTLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 59 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGSRWGQEYTLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 60 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTISSLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGSRWGQEYTLTISSLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGSGSGTDFTFTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 63 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFFVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 64 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 65 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 66 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVSPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 67 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVTPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 68 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTNLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 69 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVGPGTNLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 70 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVSPGTNLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVTPGTNLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 72 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 73 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTNVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 74 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 75 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 76 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTNVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 77 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVGPGTNVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 78 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVTPGTNVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 79 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYTLTISSLQPEDIATYFCQVYEFVVPGTNLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 80 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYTLTISSLQPEDIATYFCQVYEFVTPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 81 - protein, 206 aa, Artificial Sequence
  Description of Artificial Sequence: Synthetic polypeptide
DIQMTQSPSSLSASVGDTVTITCQANGYLNWYQQRRGKAPKLLIYDGSNLERGVPSRFSGRRWGQEYTLTISSLQPEDIATYFCQVYEFVVPGTNLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 82 - protein, 206 aa, Artificial Sequence
  Description of Artificial Sequence: Synthetic polypeptide
DIQMTQSPSSLSASVGDTVTITCQANGYLNWYQQRRGKAPKLLIYDGSNLERGVPSRFSGRRWGQEYTLTISSLQPEDIATYFCQVYEFVTPGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 83 - protein, 206 aa, Artificial Sequence
  Description of Artificial Sequence: Synthetic polypeptide
DIQMTQSPSSLSASVGDRVTITCQANGYLNWYQQKPGKAPKLLIYDGSNLETGVPSRFSGSRWGQEYTLTISSLQPEDIATYFCQVYEFVGPGTNLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 84 - protein, 206 aa, Artificial Sequence
  Description of Artificial Sequence: Synthetic polypeptide
DIQMTQSPSSLSASVGDRVTITCQANGYLNWYQQKPGKAPKLLIYDGSNLETGVPSRFSGSRWGQEYTLTISSLQPEDIATYFCQVYEFVTPGTNLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 85 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYTFTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 86 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYSLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 87 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYSFTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 88 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYALTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 89 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYAFTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 90 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYHLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 91 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYHFTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 92 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYQLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 93 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYQFTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 94 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLKINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 95 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNFKINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 96 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLAINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 97 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNFAINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 98 - protein, 206 aa, Artificial Sequence
  Description of Artificial Sequence: Synthetic polypeptide
DIQMTQSPSSLSASVGDRVTITCQANGYLNWYQQKPGKAPKLLIYDGSKLETGVPSRFSGSRWGQEYTLTINNLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 99 - protein, 206 aa, Artificial Sequence
  Description of Artificial Sequence: Synthetic polypeptide
DIQMTQSPSSLSASVGDRVTITCQANGYLNWYQQKPGKAPKLLIYDGSKLERGVPSRFSGRRWGQEYTLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 100 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYTLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 101 - protein, 206 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRWGQEYNLTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 206 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRWGQEYHLTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 103 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 104 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYNLTINNLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 105 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYHLTINNLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 106 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYHLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 107 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYHLTINNLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 108 - protein, 206 aa, Artificial Sequence
  Description of Artificial Sequence: Synthetic polypeptide
DIQMTQSPSSLSASVGDTVTITCQANGYLNWYQQKPGKAPKLLIYDGSKLERGVPSRFSGRRWGQEYNLTINNLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 109 - protein, 206 aa, Artificial Sequence
  Description of Artificial Sequence: Synthetic polypeptide
DIQMTQSPSSLSASVGDRVTITCQANGYLNWYQQRRGKAPKLLIYDGSKLERGVPSRFSGSRWGQEYNLTISSLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 110 - protein, 206 aa, Artificial Sequence
  Description of Artificial Sequence: Synthetic polypeptide
DIQMTQSPSSLSASVGDRVTITCQANGYLNWYQQKPGKAPKLLIYDGSKLERGVPSRFSGSRWGQEYNLTISSLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - protein, 206 aa, Artificial Sequence
  Description of Artificial Sequence: Synthetic polypeptide
DIQMTQSPSSLSASVGDRVTITCQANGYLNWYQQRRGKAPKLLIYDGSKLERGVPSRFSGSRWGQEYNLTISSLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 112 - protein, 206 aa, Artificial Sequence
  Description of Artificial Sequence: Synthetic polypeptide
DIQMTQSPSSLSASVGDRVTITCQANGYLNWYQQKPGKAPKLLIYDGSKLERGVPSRFSGSRWGQEYNLTISSLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 113 - protein, 206 aa, Artificial Sequence
  Description of Artificial Sequence: Synthetic polypeptide
DIQMTQSPSSLSASVGDTATITCQANGYLNWYQQKPGKAPKLLIYDGSKLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 114 - protein, 206 aa, Artificial Sequence
  Description of Artificial Sequence: Synthetic polypeptide
DIQMTQSPSSLSASVGDTATITCQANGYLNWYQQKPGKAPKLLIYDGSKLERGVPSRFSGRRWGQEYNLTINNLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 115 - protein, 206 aa, Artificial Sequence
  Description of Artificial Sequence: Synthetic polypeptide
DIQMTQSPSSLSASVGDRATITCQANGYLNWYQQRRGKAPKLLIYDGSKLERGVPSRFSGSRWGQEYNLTISSLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 116 - protein, 206 aa, Artificial Sequence
  Description of Artificial Sequence: Synthetic polypeptide
DIQMTQSPSSLSASVGDRATITCQANGYLNWYQQKPGKAPKLLIYDGSKLERGVPSRFSGSRWGQEYNLTISSLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 117 - protein, 206 aa, Artificial Sequence
  Description of Artificial Sequence: Synthetic polypeptide
DIQMTQSPSSLSASVGDRATITCQANGYLNWYQQRRGKAPKLLIYDGSKLERGVPSRFSGSRWGQEYNLTISSLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 118 - protein, 206 aa, Artificial Sequence
  Description of Artificial Sequence: Synthetic polypeptide
DIQMTQSPSSLSASVGDRATITCQANGYLNWYQQKPGKAPKLLIYDGSKLERGVPSRFSGSRWGQEYNLTISSLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 119 - protein, 206 aa, Artificial Sequence
  Description of Artificial Sequence: Synthetic polypeptide
DIQMTQSPSSLSASVGDTVTITCQANGYLNWYQQKPGKAPKLLIYDGSKLERGVPSRFSGRRWGQEYHLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 120 - protein, 206 aa, Artificial Sequence
  Description of Artificial Sequence: Synthetic polypeptide
DIQMTQSPSSLSASVGDTVTITCQANGYLNWYQQKPGKAPKLLIYDGSKLERGVPSRFSGRRWGQEYHLTINNLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 121 - protein, 206 aa, Artificial Sequence
  Description of Artificial Sequence: Synthetic polypeptide
DIQMTQSPSSLSASVGDRVTITCQANGYLNWYQQRRGKAPKLLIYDGSKLERGVPSRFSGSRWGQEYHLTISSLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 122 - protein, 206 aa, Artificial Sequence
  Description of Artificial Sequence: Synthetic polypeptide
DIQMTQSPSSLSASVGDRVTITCQANGYLNWYQQKPGKAPKLLIYDGSKLERGVPSRFSGSRWGQEYHLTISSLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 123 - protein, 206 aa, Artificial Sequence
  Description of Artificial Sequence: Synthetic polypeptide
DIQMTQSPSSLSASVGDRVTITCQANGYLNWYQQRRGKAPKLLIYDGSKLERGVPSRFSGSRWGQEYHLTISSLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 124 - protein, 206 aa, Artificial Sequence
  Description of Artificial Sequence: Synthetic polypeptide
DIQMTQSPSSLSASVGDRVTITCQANGYLNWYQQKPGKAPKLLIYDGSKLERGVPSRFSGSRWGQEYHLTISSLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 125 - protein, 206 aa, Artificial Sequence
  Description of Artificial Sequence: Synthetic polypeptide
DIQMTQSPSSLSASVGDTATITCQANGYLNWYQQKPGKAPKLLIYDGSKLERGVPSRFSGRRWGQEYHLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 126 - protein, 206 aa, Artificial Sequence
  Description of Artificial Sequence: Synthetic polypeptide
DIQMTQSPSSLSASVGDTATITCQANGYLNWYQQKPGKAPKLLIYDGSKLERGVPSRFSGRRWGQEYHLTINNLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 127 - protein, 206 aa, Artificial Sequence
  Description of Artificial Sequence: Synthetic polypeptide
DIQMTQSPSSLSASVGDRATITCQANGYLNWYQQRRGKAPKLLIYDGSKLERGVPSRFSGSRWGQEYHLTISSLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 128 - protein, 206 aa, Artificial Sequence
  Description of Artificial Sequence: Synthetic polypeptide
DIQMTQSPSSLSASVGDRATITCQANGYLNWYQQKPGKAPKLLIYDGSKLERGVPSRFSGSRWGQEYHLTISSLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 129 - protein, 206 aa, Artificial Sequence
  Description of Artificial Sequence: Synthetic polypeptide
DIQMTQSPSSLSASVGDRATITCQANGYLNWYQQRRGKAPKLLIYDGSKLERGVPSRFSGSRWGQEYHLTISSLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 130 - protein, 206 aa, Artificial Sequence
  Description of Artificial Sequence: Synthetic polypeptide
DIQMTQSPSSLSASVGDRATITCQANGYLNWYQQKPGKAPKLLIYDGSKLERGVPSRFSGSRWGQEYHLTISSLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 131 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGTRRGQDYIFSINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 132 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRFGQDYILTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGSRFGQKYQLSINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 134 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRFGQDYILTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 135 - protein, 206 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRFGQDYILTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 136 - protein, 206 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRFGQDYILTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - protein, 5 aa, Artificial Sequence
  Description of Artificial Sequence: Synthetic peptide
DYFIH

SEQ ID NO: 138 - protein, 17 aa, Artificial Sequence
  Description of Artificial Sequence: Synthetic peptide
WINPKTGQPNNPRQFQG

SEQ ID NO: 139 - protein, 10 aa, Artificial Sequence
  Description of Artificial Sequence: Synthetic peptide
QRSDYWDFDV

SEQ ID NO: 140 - protein, 7 aa, Artificial Sequence
  Description of Artificial Sequence: Synthetic peptide
QANGYLN

SEQ ID NO: 141 - protein, 7 aa, Artificial Sequence
  Description of Artificial Sequence: Synthetic peptide
DGSKLER

SEQ ID NO: 142 - protein, 5 aa, Artificial Sequence
  Description of Artificial Sequence: Synthetic peptide
QVYEF

SEQ ID NO: 143 - protein, 7 aa, Artificial Sequence
  Description of Artificial Sequence: Synthetic peptide
GYNIRDY

SEQ ID NO: 144 - protein, 4 aa, Artificial Sequence
  Description of Artificial Sequence: Synthetic peptide
PKTG

SEQ ID NO: 145 - protein, 8 aa, Artificial Sequence
  Description of Artificial Sequence: Synthetic peptide
RSDYWDFD

SEQ ID NO: 146 - protein, 3 aa, Artificial Sequence
  Description of Artificial Sequence: Synthetic peptide
NGY

SEQ ID NO: 147 - protein, 3 aa, Artificial Sequence
  Description of Artificial Sequence: Synthetic peptide
DGS

SEQ ID NO: 148 - protein, 2 aa, Artificial Sequence
  Description of Artificial Sequence: Synthetic peptide
YE

SEQ ID NO: 149 - protein, 8 aa, Artificial Sequence
  Description of Artificial Sequence: Synthetic peptide
GYNIRDYF

SEQ ID NO: 150 - protein, 8 aa, Artificial Sequence
  Description of Artificial Sequence: Synthetic peptide
INPKTGQP

SEQ ID NO: 151 - protein, 12 aa, Artificial Sequence
  Description of Artificial Sequence: Synthetic peptide
ARQRSDYWDFDV

SEQ ID NO: 152 - protein, 2 aa, Artificial Sequence
  Description of Artificial Sequence: Synthetic peptide
GY

SEQ ID NO: 153 - protein, 5 aa, Artificial Sequence
  Description of Artificial Sequence: Synthetic peptide
DHFIH

SEQ ID NO: 154 - protein, 10 aa, Artificial Sequence
  Description of Artificial Sequence: Synthetic peptide
QRSDFWDFDV

SEQ ID NO: 155 - protein, 7 aa, Artificial Sequence
  Description of Artificial Sequence: Synthetic peptide
GYKISDH

SEQ ID NO: 156 - protein, 8 aa, Artificial Sequence
  Description of Artificial Sequence: Synthetic peptide
RSDFWDFD

SEQ ID NO: 157 - protein, 8 aa, Artificial Sequence
  Description of Artificial Sequence: Synthetic peptide
GYKISDHF

SEQ ID NO: 158 - protein, 12 aa, Artificial Sequence
  Description of Artificial Sequence: Synthetic peptide
ARQRSDFWDFDV

SEQ ID NO: 159 - protein, 5 aa, Artificial Sequence
  Description of Artificial Sequence: Synthetic peptide
DYFMH

SEQ ID NO: 160 - protein, 17 aa, Artificial Sequence
  Description of Artificial Sequence: Synthetic peptide
WINPKWGQPNNPRQFQG

SEQ ID NO: 161 - protein, 17 aa, Artificial Sequence
  Description of Artificial Sequence: Synthetic peptide
WINPKGGQPNNPRQFQG

SEQ ID NO: 162 - protein, 17 aa, Artificial Sequence
  Description of Artificial Sequence: Synthetic peptide
WINPKAGQPNNPRQFQG

SEQ ID NO: 163 - protein, 17 aa, Artificial Sequence
  Description of Artificial Sequence: Synthetic peptide
WINPKHGQPNNPRQFQG

SEQ ID NO: 164 - protein, 10 aa, Artificial Sequence
  Description of Artificial Sequence: Synthetic peptide
QRTDYWDFDV

SEQ ID NO: 165 - protein, 7 aa, Artificial Sequence
  Description of Artificial Sequence: Synthetic peptide
DASKLER

SEQ ID NO: 166 - protein, 7 aa, Artificial Sequence
  Description of Artificial Sequence: Synthetic peptide
DGSNLER

SEQ ID NO: 167 - protein, 7 aa, Artificial Sequence
  Description of Artificial Sequence: Synthetic peptide
DGSKLET

SEQ ID NO: 168 - protein, 7 aa, Artificial Sequence
  Description of Artificial Sequence: Synthetic peptide
DASNLER

SEQ ID NO: 169 - protein, 4 aa, Artificial Sequence
  Description of Artificial Sequence: Synthetic peptide
PKWG

SEQ ID NO: 170 - protein, 4 aa, Artificial Sequence
  Description of Artificial Sequence: Synthetic peptide
PKGG

SEQ ID NO: 171 - protein, 4 aa, Artificial Sequence
  Description of Artificial Sequence: Synthetic peptide
PKAG

SEQ ID NO: 172 - protein, 4 aa, Artificial Sequence
  Description of Artificial Sequence: Synthetic peptide
PKHG

SEQ ID NO: 173 - protein, 8 aa, Artificial Sequence
  Description of Artificial Sequence: Synthetic peptide
RTDYWDFD

SEQ ID NO: 174 - protein, 3 aa, Artificial Sequence
  Description of Artificial Sequence: Synthetic peptide
DAS

SEQ ID NO: 175 - protein, 8 aa, Artificial Sequence
  Description of Artificial Sequence: Synthetic peptide
INPKWGQP

SEQ ID NO: 176 - protein, 8 aa, Artificial Sequence
  Description of Artificial Sequence: Synthetic peptide
INPKGGQP

SEQ ID NO: 177 - protein, 8 aa, Artificial Sequence
  Description of Artificial Sequence: Synthetic peptide
INPKAGQP

SEQ ID NO: 178 - protein, 8 aa, Artificial Sequence
  Description of Artificial Sequence: Synthetic peptide
INPKHGQP

SEQ ID NO: 179 - protein, 12 aa, Artificial Sequence
  Description of Artificial Sequence: Synthetic peptide
ARQRTDYWDFDV

SEQ ID NO: 180 - protein, 3 aa, Artificial Sequence
  Description of Artificial Sequence: Synthetic peptide
DAS

SEQ ID NO: 181 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRWGAVSYARQLQGRVTMTRDMYSETAFLELRSLTSDDTAVYFCTRGKYCTARDYYNWDFEHWGQGTPVTVSS

SEQ ID NO: 182 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 183 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRHGAVSYARQLQGRVTMTRDMYSETAFLELRSLTSDDTAVYFCTRGKYCTARDYYNWDFEHWGQGTPVTVSS

SEQ ID NO: 184 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTYSFYMDLKALRSDDTAVYFCARQRSDYWDFDVWGSGTQVTVSS

SEQ ID NO: 185 - protein, 123 aa, Artificial Sequence
  Description of Artificial Sequence: Synthetic polypeptide
QVQLLQSGAEVKKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTMVTVSS

SEQ ID NO: 186 - protein, 123 aa, Artificial Sequence
  Description of Artificial Sequence: Synthetic polypeptide
QVSLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 187 - protein, 123 aa, Artificial Sequence
  Description of Artificial Sequence: Synthetic polypeptide
QVQLVQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 188 - protein, 123 aa, Artificial Sequence
  Description of Artificial Sequence: Synthetic polypeptide
QVQLVQSGAAVTKPGASVRVSCKASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 189 - protein, 123 aa, Artificial Sequence
  Description of Artificial Sequence: Synthetic polypeptide
QVQLLQSGAEVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 190 - protein, 123 aa, Artificial Sequence
  Description of Artificial Sequence: Synthetic polypeptide
QVQLLQSGAEVKKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 191 - protein, 123 aa, Artificial Sequence
  Description of Artificial Sequence: Synthetic polypeptide
QVQLVQSGAEVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 192 - protein, 123 aa, Artificial Sequence
  Description of Artificial Sequence: Synthetic polypeptide
QVQLVQSGAEVKKPGASVRVSCKASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 193 - protein, 123 aa, Artificial Sequence
  Description of Artificial Sequence: Synthetic polypeptide
QVQLLQSGAAVTKPGASVRVSCEASGYNIRDYFMHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 194 - protein, 123 aa, Artificial Sequence
  Description of Artificial Sequence: Synthetic polypeptide
QVQLLQSGAAVTKPGASVRVSCEASGYNIRDYFMHWWRQAPGQGLQWVGWINPKTGQPNNPRQFQGRVSLTRHASWDFDTFSAYMDLKALRSDDTAVYFCARQRSDYWDFDVWGSGTQVTVSS

SEQ ID NO: 195 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKWGQPNNPRQFQGRVSLTRHASWDFDTFSFYMDLKALRSDDTAVYFCARQRSDYWDFDVWGSGTQVTVSS

SEQ ID NO: 196 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKGGQPNNPRQFQGRVSLTRHASWDFDTFSFYMDLKALRSDDTAVYFCARQRSDYWDFDVWGSGTQVTVSS

SEQ ID NO: 197 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKAGQPNNPRQFQGRVSLTRHASWDFDTFSFYMDLKALRSDDTAVYFCARQRSDYWDFDVWGSGTQVTVSS

SEQ ID NO: 198 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKHGQPNNPRQFQGRVSLTRHASWDFDTFSFYMDLKALRSDDTAVYFCARQRSDYWDFDVWGSGTQVTVSS

SEQ ID NO: 199 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVTLTRHASWDFDTFSFYMDLKALRSDDTAVYFCARQRSDYWDFDVWGSGTQVTVSS

SEQ ID NO: 200 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVTMTRHASWDFDTFSFYMDLKALRSDDTAVYFCARQRSDYWDFDVWGSGTQVTVSS

SEQ ID NO: 201 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRDASWDFDTFSFYMDLKALRSDDTAVYFCARQRSDYWDFDVWGSGTQVTVSS

SEQ ID NO: 202 - protein, 119 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASTFSFYMDLKALRSDDTAVYFCARQRSDYWDFDVWGSGTQVTVSS

SEQ ID NO: 203 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFSMDLKALRSDDTAVYFCARQRSDYWDFDVWGSGTQVTVSS

SEQ ID NO: 204 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLSRLRSDDTAVYFCARQRSDYWDFDVWGSGTQVTVSS

SEQ ID NO: 205 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTATYFCARQRSDYWDFDVWGSGTQVTVSS

SEQ ID NO: 206 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRTDYWDFDVWGSGTQVTVSS

SEQ ID NO: 207 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTATYFCARQRTDYWDFDVWGSGTQVTVSS

SEQ ID NO: 208 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGQGTQVTVSS

SEQ ID NO: 209 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTMVTVSS

SEQ ID NO: 210 - protein, 123 aa, Artificial Sequence
  Description of Artificial Sequence: Synthetic polypeptide
QVQLLQSGAAVTKPGASVRVSCEASGYNIRDYFIHWVRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 211 - protein, 123 aa, Artificial Sequence
  Description of Artificial Sequence: Synthetic polypeptide
QVQLLQSGAAVTKPGASVRVSCEASGYNIRDYFMHWVRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 212 - protein, 123 aa, Artificial Sequence
  Description of Artificial Sequence: Synthetic polypeptide
QVQLLQSGAAVTKPGASVRVSCEASGYNIRDYFMHWVRQAPGQGLQWVGWINPKTGQPNNPRQFQGRVSLTRHASWDFDTFSAYMDLKALRSDDTAVYFCARQRSDYWDFDVWGSGTQVTVSS

SEQ ID NO: 213 - protein, 123 aa, Artificial Sequence
  Description of Artificial Sequence: Synthetic polypeptide
QVQLVQSGAEVTKPGASVRVSCEASGYNIRDYFIHWWRQAPGQGLQWVGWINPKTGQPNNPRQFQGRVSLTRHASWDFDTFSFYMDLKALRSDDTATYFCARQRSDYWDFDVWGSGTQVTVSS

SEQ ID NO: 214 - protein, 123 aa, Artificial Sequence
  Description of Artificial Sequence: Synthetic polypeptide
QVQLVQSGAEVTKPGASVRVSCEASGYNIRDYFIHWWRQAPGQGLQWVGWINPKTGQPNNPRQFQGRVSLTRHASWDFDTFSFYMDLKALRSDDTAVYFCARQRTDYWDFDVWGSGTQVTVSS

SEQ ID NO: 215 - protein, 123 aa, Artificial Sequence
  Description of Artificial Sequence: Synthetic polypeptide
QVQLVQSGAEVKKPGASVRVSCKASGYNIRDYFIHWWRQAPGQGLQWVGWINPKTGQPNNPRQFQGRVTLTRHASWDFDTFSFYMDLKALRSDDTATYFCARQRSDYWDFDVWGSGTQVTVSS

SEQ ID NO: 216 - protein, 123 aa, Artificial Sequence
  Description of Artificial Sequence: Synthetic polypeptide
QVQLVQSGAEVKKPGASVRVSCKASGYNIRDYFIHWWRQAPGQGLQWVGWINPKTGQPNNPRQFQGRVTLTRHASWDFDTFSFYMDLKALRSDDTAVYFCARQRTDYWDFDVWGSGTQVTVSS

SEQ ID NO: 217 - protein, 123 aa, Artificial Sequence
  Description of Artificial Sequence: Synthetic polypeptide
QVQLVQSGAEVKKPGASVRVSCKASGYNIRDYFMHWWRQAPGQGLQWVGWINPKTGQPNNPRQFQGRVTMTRHASWDFDTFSFYMDLSRLRSDDTATYFCARQRTDYWDFDVWGQGTMVTVSS

SEQ ID NO: 218 - protein, 123 aa, Artificial Sequence
  Description of Artificial Sequence: Synthetic polypeptide
QVQLVQSGAEVKKPGASVRVSCKASGYNIRDYFMHWWRQAPGQGLQWVGWINPKTGQPNNPRQFQGRVTMTRHASWDFDTFSAYMDLSRLRSDDTATYFCARQRTDYWDFDVWGQGTMVTVSS

SEQ ID NO: 219 - protein, 123 aa, Artificial Sequence
  Description of Artificial Sequence: Synthetic polypeptide
QVQLVQSGAEVKKPGASVRVSCKASGYNIRDYFIHWWRQAPGQGLQWVGWINPKTGQPNNPRQFQGRVSLTRHASWDFDTYSFYMDLSRLRSDDTAVYFCARQRSDYWDFDVWGQGTMVTVSS

SEQ ID NO: 220 - protein, 123 aa, Artificial Sequence
  Description of Artificial Sequence: Synthetic polypeptide
QVHLSQSGAAVTKPGASVRVSCEASGYKISDHFIHWWRQAPGQGLQWVGWINPKTGQPNNPRQFQGRVSLTRQASWDFDTYSFYMDLKAVRSDDTAIYFCARQRSDFWDFDVWGSGTQVTVSS

SEQ ID NO: 221 - protein, 123 aa, Artificial Sequence
  Description of Artificial Sequence: Synthetic polypeptide
QVQLVQSGAEVKKPGASVRVSCKASGYNIRDYFIHWWRQAPGQGLQWVGWINPKTGQPNNPRQFQGRVSLTRHASWDFDTFSFYMDLKALRSDDTAVYFCARQRSDYWDFDVWGQGTMVTVSS

SEQ ID NO: 222 - protein, 103 aa, Artificial Sequence
  Description of Artificial Sequence: Synthetic polypeptide
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 223 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLK

SEQ ID NO: 224 - protein, 101 aa, Artificial Sequence
  Description of Artificial Sequence: Synthetic polypeptide
SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 225 - protein, 99 aa, Artificial Sequence
  Description of Artificial Sequence: Synthetic polypeptide
DIQMTQSPSSLSASVGDTVTITCQANGYLNWYQQKPGKAPKLLIYDGSKLERGVPSRFSGRRWGQEYNLTINNLQPEDIATYFCQVYEFVVPGTKVDIK

SEQ ID NO: 226 - protein, 99 aa, Artificial Sequence
  Description of Artificial Sequence: Synthetic polypeptide
EIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLK

SEQ ID NO: 227 - protein, 99 aa, Artificial Sequence
  Description of Artificial Sequence: Synthetic polypeptide
DIQMTQSPSSLSASVGDRVTITCQANGYLNWYQQRRGKAPKLLIYDGSKLERGVPSRFSGRRWGQEYNLTINNLQPEDIATYFCQVYEFVVPGTRLDLK

SEQ ID NO: 228 - protein, 99 aa, Artificial Sequence
  Description of Artificial Sequence: Synthetic polypeptide
DIQMTQSPSSLSASVGDTVTITCQANGYLNWYQQKPGKAPKLLIYDGSKLERGVPSRFSGRRWGQEYNLTINNLQPEDIATYFCQVYEFVVPGTRLDLK

SEQ ID NO: 229 - protein, 99 aa, Artificial Sequence
  Description of Artificial Sequence: Synthetic polypeptide
DIQMTQSPSSLSASVGDTVTITCQANGYLNWYQQRRGKAPKLLIYDASKLERGVPSRFSGRRWGQEYNLTINNLQPEDIATYFCQVYEFVVPGTRLDLK

SEQ ID NO: 230 - protein, 99 aa, Artificial Sequence
  Description of Artificial Sequence: Synthetic polypeptide
DIQMTQSPSSLSASVGDTVTITCQANGYLNWYQQRRGKAPKLLIYDGSNLERGVPSRFSGRRWGQEYNLTINNLQPEDIATYFCQVYEFVVPGTRLDLK

SEQ ID NO: 231 - protein, 99 aa, Artificial Sequence
  Description of Artificial Sequence: Synthetic polypeptide
DIQMTQSPSSLSASVGDTVTITCQANGYLNWYQQRRGKAPKLLIYDASNLERGVPSRFSGRRWGQEYNLTINNLQPEDIATYFCQVYEFVVPGTRLDLK

SEQ ID NO: 232 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLETGVPSRFSGRRWGQEYNLTINNLQPEDIATYFCQVYEFVVPGTRLDLK

SEQ ID NO: 233 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYTLTINNLQPEDIATYFCQVYEFVVPGTRLDLK

SEQ ID NO: 234 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGSRWGQEYTLTINNLQPEDIATYFCQVYEFVVPGTRLDLK

SEQ ID NO: 235 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTISSLQPEDIATYFCQVYEFVVPGTRLDLK

SEQ ID NO: 236 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGSRWGQEYTLTISSLQPEDIATYFCQVYEFVVPGTRLDLK

SEQ ID NO: 237 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGSGSGTDFTFTINNLQPEDIATYFCQVYEFVVPGTRLDLK

SEQ ID NO: 238 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFFVPGTRLDLK

SEQ ID NO: 239 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVGPGTRLDLK

SEQ ID NO: 240 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFFGPGTRLDLK

SEQ ID NO: 241 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVSPGTRLDLK

SEQ ID NO: 242 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVTPGTRLDLK

SEQ ID NO: 243 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTNLDLK

SEQ ID NO: 244 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVGPGTNLDLK

SEQ ID NO: 245 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVSPGTNLDLK

SEQ ID NO: 246 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVTPGTNLDLK

SEQ ID NO: 247 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRVDLK

SEQ ID NO: 248 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTNVDLK

SEQ ID NO: 249 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDIK

SEQ ID NO: 250 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRVDIK

SEQ ID NO: 251 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTNVDIK

SEQ ID NO: 252 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVGPGTNVDIK

SEQ ID NO: 253 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVTPGTNVDIK

SEQ ID NO: 254 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYTLTISSLQPEDIATYFCQVYEFVVPGTNLDLK

SEQ ID NO: 255 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYTLTISSLQPEDIATYFCQVYEFVTPGTRLDLK

SEQ ID NO: 256 - protein, 99 aa, Artificial Sequence
  Description of Artificial Sequence: Synthetic polypeptide
DIQMTQSPSSLSASVGDTVTITCQANGYLNWYQQRRGKAPKLLIYDGSNLERGVPSRFSGRRWGQEYTLTISSLQPEDIATYFCQVYEFVVPGTNLDIK

SEQ ID NO: 257 - protein, 99 aa, Artificial Sequence
  Description of Artificial Sequence: Synthetic polypeptide
DIQMTQSPSSLSASVGDTVTITCQANGYLNWYQQRRGKAPKLLIYDGSNLERGVPSRFSGRRWGQEYTLTISSLQPEDIATYFCQVYEFVTPGTRLDIK

SEQ ID NO: 258 - protein, 99 aa, Artificial Sequence
  Description of Artificial Sequence: Synthetic polypeptide
DIQMTQSPSSLSASVGDRVTITCQANGYLNWYQQKPGKAPKLLIYDGSNLETGVPSRFSGSRWGQEYTLTISSLQPEDIATYFCQVYEFVGPGTNLDIK

SEQ ID NO: 259 - protein, 99 aa, Artificial Sequence
  Description of Artificial Sequence: Synthetic polypeptide
DIQMTQSPSSLSASVGDRVTITCQANGYLNWYQQKPGKAPKLLIYDGSNLETGVPSRFSGSRWGQEYTLTISSLQPEDIATYFCQVYEFVTPGTNLDIK

SEQ ID NO: 260 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYTFTINNLQPEDIATYFCQVYEFVVPGTRLDLK

SEQ ID NO: 261 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYSLTINNLQPEDIATYFCQVYEFVVPGTRLDLK

SEQ ID NO: 262 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYSFTINNLQPEDIATYFCQVYEFVVPGTRLDLK

SEQ ID NO: 263 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYALTINNLQPEDIATYFCQVYEFVVPGTRLDLK

SEQ ID NO: 264 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYAFTINNLQPEDIATYFCQVYEFVVPGTRLDLK

SEQ ID NO: 265 - protein, 100 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYHLTINNLQPEDIATYFCQVYEFVVPGTRLDLKR

SEQ ID NO: 266 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYHFTINNLQPEDIATYFCQVYEFVVPGTRLDLK

SEQ ID NO: 267 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYQLTINNLQPEDIATYFCQVYEFVVPGTRLDLK

SEQ ID NO: 268 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYQFTINNLQPEDIATYFCQVYEFVVPGTRLDLK

SEQ ID NO: 269 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLKINNLQPEDIATYFCQVYEFVVPGTRLDLK

SEQ ID NO: 270 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNFKINNLQPEDIATYFCQVYEFVVPGTRLDLK

SEQ ID NO: 271 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLAINNLQPEDIATYFCQVYEFVVPGTRLDLK

SEQ ID NO: 272 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNFAINNLQPEDIATYFCQVYEFVVPGTRLDLK

SEQ ID NO: 273 - protein, 99 aa, Artificial Sequence
  Description of Artificial Sequence: Synthetic polypeptide
DIQMTQSPSSLSASVGDRVTITCQANGYLNWYQQKPGKAPKLLIYDGSKLETGVPSRFSGSRWGQEYTLTINNLQPEDIATYFCQVYEFFGPGTRLDLK

SEQ ID NO: 274 - protein, 99 aa, Artificial Sequence
  Description of Artificial Sequence: Synthetic polypeptide
DIQMTQSPSSLSASVGDRVTITCQANGYLNWYQQKPGKAPKLLIYDGSKLERGVPSRFSGRRWGQEYTLTINNLQPEDIATYFCQVYEFVVPGTRLDLK

SEQ ID NO: 275 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYTLTINNLQPEDIATYFCQVYEFVVPGTRLDLK

SEQ ID NO: 276 - protein, 99 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRWGQEYNLTINNLQPEDVATYFCQVYEFIVPGTRLDLK

SEQ ID NO: 277 - protein, 99 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRWGQEYHLTINNLQPEDVATYFCQVYEFIVPGTRLDLK

SEQ ID NO: 278 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYNLTINNLQPEDIATYFCQVYEFVVPGTRLDLK

SEQ ID NO: 279 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYNLTINNLQPEDIATYFCQVYEFFGPGTRLDLK

SEQ ID NO: 280 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYHLTINNLQPEDIATYFCQVYEFFGPGTRLDLK

SEQ ID NO: 281 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYHLTINNLQPEDIATYFCQVYEFVVPGTRLDLK

SEQ ID NO: 282 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYHLTINNLQPEDIATYFCQVYEFFGPGTRLDLK

SEQ ID NO: 283 - protein, 99 aa, Artificial Sequence
  Description of Artificial Sequence: Synthetic polypeptide
DIQMTQSPSSLSASVGDTVTITCQANGYLNWYQQKPGKAPKLLIYDGSKLERGVPSRFSGRRWGQEYNLTINNLQPEDIATYFCQVYEFFGPGTRLDLK

SEQ ID NO: 284 - protein, 99 aa, Artificial Sequence
  Description of Artificial Sequence: Synthetic polypeptide
DIQMTQSPSSLSASVGDRVTITCQANGYLNWYQQRRGKAPKLLIYDGSKLERGVPSRFSGSRWGQEYNLTISSLQPEDIATYFCQVYEFVVPGTRLDLK

SEQ ID NO: 285 - protein, 99 aa, Artificial Sequence
  Description of Artificial Sequence: Synthetic polypeptide
DIQMTQSPSSLSASVGDRVTITCQANGYLNWYQQKPGKAPKLLIYDGSKLERGVPSRFSGSRWGQEYNLTISSLQPEDIATYFCQVYEFVVPGTRLDLK

SEQ ID NO: 286 - protein, 99 aa, Artificial Sequence
  Description of Artificial Sequence: Synthetic polypeptide
DIQMTQSPSSLSASVGDRVTITCQANGYLNWYQQRRGKAPKLLIYDGSKLERGVPSRFSGSRWGQEYNLTISSLQPEDIATYFCQVYEFFGPGTRLDLK

SEQ ID NO: 287 - protein, 99 aa, Artificial Sequence
  Description of Artificial Sequence: Synthetic polypeptide
DIQMTQSPSSLSASVGDRVTITCQANGYLNWYQQKPGKAPKLLIYDGSKLERGVPSRFSGSRWGQEYNLTISSLQPEDIATYFCQVYEFFGPGTRLDLK

SEQ ID NO: 288 - protein, 99 aa, Artificial Sequence
  Description of Artificial Sequence: Synthetic polypeptide
DIQMTQSPSSLSASVGDTATITCQANGYLNWYQQKPGKAPKLLIYDGSKLERGVPSRFSGRRWGQEYNLTINNLQPEDIATYFCQVYEFVVPGTRLDLK

SEQ ID NO: 289 - protein, 99 aa, Artificial Sequence
  Description of Artificial Sequence: Synthetic polypeptide
DIQMTQSPSSLSASVGDTATITCQANGYLNWYQQKPGKAPKLLIYDGSKLERGVPSRFSGRRWGQEYNLTINNLQPEDIATYFCQVYEFFGPGTRLDLK

SEQ ID NO: 290 - protein, 99 aa, Artificial Sequence
  Description of Artificial Sequence: Synthetic polypeptide
DIQMTQSPSSLSASVGDRATITCQANGYLNWYQQRRGKAPKLLIYDGSKLERGVPSRFSGSRWGQEYNLTISSLQPEDIATYFCQVYEFVVPGTRLDLK

SEQ ID NO: 291 - protein, 99 aa, Artificial Sequence
  Description of Artificial Sequence: Synthetic polypeptide
DIQMTQSPSSLSASVGDRATITCQANGYLNWYQQKPGKAPKLLIYDGSKLERGVPSRFSGSRWGQEYNLTISSLQPEDIATYFCQVYEFVVPGTRLDLK

SEQ ID NO: 292 - protein, 99 aa, Artificial Sequence
  Description of Artificial Sequence: Synthetic polypeptide
DIQMTQSPSSLSASVGDRATITCQANGYLNWYQQRRGKAPKLLIYDGSKLERGVPSRFSGSRWGQEYNLTISSLQPEDIATYFCQVYEFFGPGTRLDLK

SEQ ID NO: 293 - protein, 99 aa, Artificial Sequence
  Description of Artificial Sequence: Synthetic polypeptide
DIQMTQSPSSLSASVGDRATITCQANGYLNWYQQKPGKAPKLLIYDGSKLERGVPSRFSGSRWGQEYNLTISSLQPEDIATYFCQVYEFFGPGTRLDLK

SEQ ID NO: 294 - protein, 99 aa, Artificial Sequence
  Description of Artificial Sequence: Synthetic polypeptide
DIQMTQSPSSLSASVGDTVTITCQANGYLNWYQQKPGKAPKLLIYDGSKLERGVPSRFSGRRWGQEYHLTINNLQPEDIATYFCQVYEFVVPGTRLDLK

SEQ ID NO: 295 - protein, 99 aa, Artificial Sequence
  Description of Artificial Sequence: Synthetic polypeptide
DIQMTQSPSSLSASVGDTVTITCQANGYLNWYQQKPGKAPKLLIYDGSKLERGVPSRFSGRRWGQEYHLTINNLQPEDIATYFCQVYEFFGPGTRLDLK

SEQ ID NO: 296 - protein, 99 aa, Artificial Sequence
  Description of Artificial Sequence: Synthetic polypeptide
DIQMTQSPSSLSASVGDRVTITCQANGYLNWYQQRRGKAPKLLIYDGSKLERGVPSRFSGSRWGQEYHLTISSLQPEDIATYFCQVYEFVVPGTRLDLK

SEQ ID NO: 297 - protein, 99 aa, Artificial Sequence
  Description of Artificial Sequence: Synthetic polypeptide
DIQMTQSPSSLSASVGDRVTITCQANGYLNWYQQKPGKAPKLLIYDGSKLERGVPSRFSGSRWGQEYHLTISSLQPEDIATYFCQVYEFVVPGTRLDLK

SEQ ID NO: 298 - protein, 99 aa, Artificial Sequence
  Description of Artificial Sequence: Synthetic polypeptide
DIQMTQSPSSLSASVGDRVTITCQANGYLNWYQQRRGKAPKLLIYDGSKLERGVPSRFSGSRWGQEYHLTISSLQPEDIATYFCQVYEFFGPGTRLDLK

SEQ ID NO: 299 - protein, 99 aa, Artificial Sequence
  Description of Artificial Sequence: Synthetic polypeptide
DIQMTQSPSSLSASVGDRVTITCQANGYLNWYQQKPGKAPKLLIYDGSKLERGVPSRFSGSRWGQEYHLTISSLQPEDIATYFCQVYEFFGPGTRLDLK

SEQ ID NO: 300 - protein, 99 aa, Artificial Sequence
  Description of Artificial Sequence: Synthetic polypeptide
DIQMTQSPSSLSASVGDTATITCQANGYLNWYQQKPGKAPKLLIYDGSKLERGVPSRFSGRRWGQEYHLTINNLQPEDIATYFCQVYEFVVPGTRLDLK

SEQ ID NO: 301 - protein, 99 aa, Artificial Sequence
  Description of Artificial Sequence: Synthetic polypeptide
DIQMTQSPSSLSASVGDTATITCQANGYLNWYQQKPGKAPKLLIYDGSKLERGVPSRFSGRRWGQEYHLTINNLQPEDIATYFCQVYEFFGPGTRLDLK

SEQ ID NO: 302 - protein, 99 aa, Artificial Sequence
  Description of Artificial Sequence: Synthetic polypeptide
DIQMTQSPSSLSASVGDRATITCQANGYLNWYQQRRGKAPKLLIYDGSKLERGVPSRFSGSRWGQEYHLTISSLQPEDIATYFCQVYEFVVPGTRLDLK

SEQ ID NO: 303 - protein, 99 aa, Artificial Sequence
  Description of Artificial Sequence: Synthetic polypeptide
DIQMTQSPSSLSASVGDRATITCQANGYLNWYQQKPGKAPKLLIYDGSKLERGVPSRFSGSRWGQEYHLTISSLQPEDIATYFCQVYEFVVPGTRLDLK

SEQ ID NO: 304 - protein, 99 aa, Artificial Sequence
  Description of Artificial Sequence: Synthetic polypeptide
DIQMTQSPSSLSASVGDRATITCQANGYLNWYQQRRGKAPKLLIYDGSKLERGVPSRFSGSRWGQEYHLTISSLQPEDIATYFCQVYEFFGPGTRLDLK

SEQ ID NO: 305 - protein, 99 aa, Artificial Sequence
  Description of Artificial Sequence: Synthetic polypeptide
DIQMTQSPSSLSASVGDRATITCQANGYLNWYQQKPGKAPKLLIYDGSKLERGVPSRFSGSRWGQEYHLTISSLQPEDIATYFCQVYEFFGPGTRLDLK

SEQ ID NO: 306 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGTRRGQDYIFSINNLQPEDIATYFCQVYEFVVPGTRLDLK

SEQ ID NO: 307 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRFGQDYILTINNLQPEDIATYFCQVYEFVVPGTRLDLK

SEQ ID NO: 308 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGSRFGQKYQLSINNLQPEDIATYFCQVYEFVVPGTRLDLK

SEQ ID NO: 309 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRFGQDYILTINNLQPEDIATYFCQVYEFVVPGTRLDLK

SEQ ID NO: 310 - protein, 99 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRFGQDYILTINNLQPEDVATYFCQVYEFIVPGTRLDLK

SEQ ID NO: 311 - protein, 99 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRFGQDYILTINNLQPEDVATYFCQVYEFIVPGTRLDLK

SEQ ID NO: 312-319 - skipped (8 entries)

SEQ ID NO: 320 - protein, 15 aa, Artificial Sequence
  Description of Artificial Sequence: Synthetic peptide
GDTVTITCQANGYLN

SEQ ID NO: 321 - protein, 9 aa, Artificial Sequence
  Description of Artificial Sequence: Synthetic peptide
VTITCQANG

SEQ ID NO: 322-331 - skipped (10 entries)

SEQ ID NO: 332 - protein, 10 aa, Artificial Sequence
  Description of Artificial Sequence: Synthetic peptide
TRRGQQYNLT

SEQ ID NO: 333 - protein, 10 aa, Artificial Sequence
  Description of Artificial Sequence: Synthetic peptide
RRWGQNYNFT

SEQ ID NO: 334 - protein, 10 aa, Artificial Sequence
  Description of Artificial Sequence: Synthetic peptide
TRRGQDYIFS

SEQ ID NO: 335 - protein, 10 aa, Artificial Sequence
  Description of Artificial Sequence: Synthetic peptide
RRRGQDYILA

SEQ ID NO: 336 - protein, 10 aa, Artificial Sequence
  Description of Artificial Sequence: Synthetic peptide
RRRGQNYTFT

SEQ ID NO: 337 - protein, 10 aa, Artificial Sequence
  Description of Artificial Sequence: Synthetic peptide
RRFGQDYILT

SEQ ID NO: 338 - protein, 10 aa, Artificial Sequence
  Description of Artificial Sequence: Synthetic peptide
TRFGQNYSLQ

SEQ ID NO: 339 - protein, 10 aa, Artificial Sequence
  Description of Artificial Sequence: Synthetic peptide
TRRGQNYTLA

SEQ ID NO: 340 - protein, 10 aa, Artificial Sequence
  Description of Artificial Sequence: Synthetic peptide
TRRGQQYTLP

SEQ ID NO: 341 - protein, 10 aa, Artificial Sequence
  Description of Artificial Sequence: Synthetic peptide
TRRGQDYILA

SEQ ID NO: 342 - protein, 10 aa, Artificial Sequence
  Description of Artificial Sequence: Synthetic peptide
SRFGQKYQLS

SEQ ID NO: 343 - protein, 849 aa, Human immunodeficiency virus 1
MKVMGTKKNYQHLWRWGIMLLGMLMMSSAAEQLWVTVYYGVPVWREANTTLFCASDAKAYDTEVHNVWATHACVPTDPNPQEVVMGNVTEDFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTSYRLINCNTSVITQACPKVSFEPIPIHYCAPAGFAILKCNNKTFNGKGPCRNVSTVQCTHGIKPVVSTQLLLNGSLAEEDIIIRSENFTNNGKNIIVQLKEPVKINCTRPGNNTRRSINIGPGRAFYATGAIIGDIRKAHCNISTEQWNNTLTQIVDKLREQFGNKTIIFNQSSGGDPEVVMHTFNCGGEFFYCNSTQLFNSTWFNNGTSTWNSTADNITLPCRIKQVINMWQEVGKAMYAPPIRGQIDCSSNITGLILTRDGGSNSSQNETFRPGGGNMKDNWRSELYKYKVVKIEPLGIAPTRAKRRVVQREKRAVTLGAVFLGFLGAAGSTMGAASLTLTVQARLLLSGIVQQQSNLLRAIEAQQHMLQLTVWGIKQLQARVLAIERYLKDQQLLGIWGCSGKLICTTTVPWNTSWSNKSYDYIWNNMTWMQWEREIDNYTGFIYTLIEESQNQQEKNELELLELDKWASLWNWFNITNWLWYIKLFIMIIGGLVGLRIVCAVLSIVNRVRQGYSPLSFQTRLPNPRGPDRPEETEGEGGERDRDRSARLVNGFLAIIWDDLRSLCLFSYHRLRDLLLIVARVVEILGRRGWEILKYWWNLLKYWSQELKNSAVSLLNVTAIAVAEGTDRVIEIVQRAVRAILHIPTRIRQGFERALL

SEQ ID NO: 344 - protein, 475 aa, Human immunodeficiency virus 1
AEQLWVTVYYGVPVWREANTTLFCASDAKAYDTEVHNVWATHACVPTDPNPQEVVMGNVTEDFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTSYRLINCNTSVITQACPKVSFEPIPIHYCAPAGFAILKCNNKTFNGKGPCRNVSTVQCTHGIKPVVSTQLLLNGSLAEEDIIIRSENFTNNGKNIIVQLKEPVKINCTRPGNNTRRSINIGPGRAFYATGAIIGDIRKAHCNISTEQWNNTLTQIVDKLREQFGNKTIIFNQSSGGDPEVVMHTFNCGGEFFYCNSTQLFNSTWFNNGTSTWNSTADNITLPCRIKQVINMWQEVGKAMYAPPIRGQIDCSSNITGLILTRDGGSNSSQNETFRPGGGNMKDNWRSELYKYKVVKIEPLGIAPTRAKRRVVQREKR

SEQ ID NO: 345 - protein, 481 aa, Human immunodeficiency virus 1
TEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKR

SEQ ID NO: 346 - protein, 35 aa, Human immunodeficiency virus 1
CTRPNNNTRKSIHIGPGRAFYTTGEIIGDIRQAHC

SEQ ID NO: 347 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 348 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 349 - protein, 107 aa, Homo sapiens
RTVAAPSVFIFPPSDEQLKSGTASVVCLLNNFYPREAKVQWKVDNVLQSGNSQESVTEQDSKDSTYSLSSTLTLSKADYEKHKLYACEVTHQGLSSPVTKSFNRGEC

SEQ ID NO: 350 - protein, 107 aa, Homo sapiens
RTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 351 - protein, 107 aa, Homo sapiens [sequence omitted]

SEQ ID NO: 352 - protein, 106 aa, Homo sapiens
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 353 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 354 - protein, 106 aa, Homo sapiens
GQPKAAPSVTLFPPSSEELQANKATLVCLISDFYPGAVTVAWKADSSPAKAGVETTTPSKQSNNKYAASSYLSLTPEQWKSHKSYSCQVTHEGSTVEKTVAPTECS

SEQ ID NO: 355 - protein, 106 aa, Homo sapiens
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 356-426 - skipped (71 entries)

SEQ ID NO: 427 - protein, 4 aa, Artificial Sequence
  Description of Artificial Sequence: Synthetic peptide
GGGS

SEQ ID NO: 428 - protein, 4 aa, Artificial Sequence
  Description of Artificial Sequence: Synthetic peptide
SGGG

SEQ ID NO: 429 - protein, 5 aa, Artificial Sequence
  Description of Artificial Sequence: Synthetic peptide
GGGGS

SEQ ID NO: 430 - protein, 5 aa, Artificial Sequence
  Description of Artificial Sequence: Synthetic peptide
SGGGG

SEQ ID NO: 431 - protein, 6 aa, Artificial Sequence
  Description of Artificial Sequence: Synthetic peptide
GGGGGS

SEQ ID NO: 432 - protein, 6 aa, Artificial Sequence
  Description of Artificial Sequence: Synthetic peptide
SGGGGG

SEQ ID NO: 433 - protein, 7 aa, Artificial Sequence
  Description of Artificial Sequence: Synthetic peptide
GGGGGGS

SEQ ID NO: 434 - protein, 7 aa, Artificial Sequence
  Description of Artificial Sequence: Synthetic peptide
SGGGGGG

SEQ ID NO: 435 - protein, 5 aa, Artificial Sequence
  Description of Artificial Sequence: Synthetic peptide
GGGGS

SEQ ID NO: 436 - protein, 5 aa, Artificial Sequence
  Description of Artificial Sequence: Synthetic peptide
SGGGG

SEQ ID NO: 437 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 438 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 439 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 440 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 441 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 442 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLLPPKPKDTLMISRTPEVTCVVVDVSHEDPEVKFNWYVDGVEVHNAKTKPPEEQYNSTLRVVSILTVLHQDWLNGKEYKCKVSNKALPAPIEKTISKAKGQPREPQVYTLPPSREEMTKNQVSLTCLVKGFYPSDIAVEWESNGQPENNYKTTPLVLDSDGSFFLYSKLTVDKSRWQQGNVFSCSVLHEALHSHYTQKSLSLSPGK

SEQ ID NO: 443 - protein, 462 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYNPSLKSRVHLSLDTSKNQVSLSLTGVTAADSGKYYCARTLHGRRIYGIVAFNEWFTYFYMDVWGTGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 444 - protein, 5 aa, Artificial Sequence
  Description of Artificial Sequence: Synthetic peptide
DSYWS

SEQ ID NO: 445 - protein, 16 aa, Artificial Sequence
  Description of Artificial Sequence: Synthetic peptide
YVHKSGDTNYNPSLKS

SEQ ID NO: 446 - protein, 24 aa, Artificial Sequence
  Description of Artificial Sequence: Synthetic peptide
TLHGRRIYGIVAFNEWFTYFYMDV

SEQ ID NO: 447 - protein, 211 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDSRPGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 448 - protein, 11 aa, Artificial Sequence
  Description of Artificial Sequence: Synthetic peptide
GEKSLGSRAVQ

SEQ ID NO: 449 - protein, 7 aa, Artificial Sequence
  Description of Artificial Sequence: Synthetic peptide
NNQDRPS

SEQ ID NO: 450 - protein, 12 aa, Artificial Sequence
  Description of Artificial Sequence: Synthetic peptide
HIWDSRVPTKWV

SEQ ID NO: 451 - protein, 462 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYNPSLKSRVHLSLDTSKNQVSLSLSSVTAADSGKYYCARTLHGRRIYGIVAFNEWFTYFYMDVWGKGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 452 - protein, 211 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 453 - protein, 4 aa, Artificial Sequence
  Description of Artificial Sequence: Synthetic peptide
WDFD

SEQ ID NO: 454 - protein, 462 aa, Artificial Sequence; identical to SEQ ID NO: 443
  Description of Artificial Sequence: Synthetic polypeptide

SEQ ID NO: 455 - protein, 211 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDYRPGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 456 - protein, 211 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDFRPGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 457 - protein, 7 aa, Artificial Sequence
  Description of Artificial Sequence: Synthetic peptide
GYKIRDH

SEQ ID NO: 458 - protein, 8 aa, Artificial Sequence
  Description of Artificial Sequence: Synthetic peptide
GYKIRDHF

SEQ ID NO: 459 - protein, 7 aa, Artificial Sequence
  Description of Artificial Sequence: Synthetic peptide
GYKIRDY

SEQ ID NO: 460 - protein, 7 aa, Artificial Sequence
  Description of Artificial Sequence: Synthetic peptide
GYNISDY

SEQ ID NO: 461 - protein, 7 aa, Artificial Sequence
  Description of Artificial Sequence: Synthetic peptide
GYNIRDH

SEQ ID NO: 462 - protein, 8 aa, Artificial Sequence
  Description of Artificial Sequence: Synthetic peptide
GYKIRDYF

SEQ ID NO: 463 - protein, 8 aa, Artificial Sequence
  Description of Artificial Sequence: Synthetic peptide
GYNISDYF

SEQ ID NO: 464 - protein, 8 aa, Artificial Sequence
  Description of Artificial Sequence: Synthetic peptide
GYNIRDHF

SEQ ID NO: 465 - protein, 123 aa, Artificial Sequence
  Description of Artificial Sequence: Synthetic polypeptide
QVHLSQSGAAVTKPGASVRVSCEASGYKIRDHFIHWWRQAPGQGLQWVGWINPKTGQPNNPRQFQGRVSLTRHASWDFDTFSFYMDLKAVRSDDTAIYFCARQRSDYWDFDVWGSGTQVTVSS

SEQ ID NO: 466 - protein, 123 aa, Artificial Sequence
  Description of Artificial Sequence: Synthetic polypeptide
QVHLSQSGAAVTKPGASVRVSCEASGYNIRDYFIHWWRQAPGQGLQWVGWINPKTGQPNNPRQFQGRVSLTRHASWDFDTFSFYMDLKAVRSDDTAIYFCARQRSDYWDFDVWGSGTQVTVSS

SEQ ID NO: 467 - protein, 123 aa, Artificial Sequence
  Description of Artificial Sequence: Synthetic polypeptide
QVHLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 468 - protein, 123 aa, Artificial Sequence
  Description of Artificial Sequence: Synthetic polypeptide
QVQLSQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 469 - protein, 123 aa, Artificial Sequence
  Description of Artificial Sequence: Synthetic polypeptide
QVQLLQSGAAVTKPGASVRVSCEASGYKIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 470 - protein, 123 aa, Artificial Sequence
  Description of Artificial Sequence: Synthetic polypeptide
QVQLLQSGAAVTKPGASVRVSCEASGYNISDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 471 - protein, 123 aa, Artificial Sequence
  Description of Artificial Sequence: Synthetic polypeptide
QVQLLQSGAAVTKPGASVRVSCEASGYNIRDHFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 472 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRQASWDFDTFSFYMDLKALRSDDTAVYFCARQRSDYWDFDVWGSGTQVTVSS

SEQ ID NO: 473 - skipped

SEQ ID NO: 474 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKAVRSDDTAVYFCARQRSDYWDFDVWGSGTQVTVSS

SEQ ID NO: 475 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAIYFCARQRSDYWDFDVWGSGTQVTVSS

SEQ ID NO: 476 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDFWDFDVWGSGTQVTVSS

SEQ ID NO: 477 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASFDFDTFSFYMDLKALRSDDTAVYFCARQRSDYWDFDVWGSGTQVTVSS

SEQ ID NO: 478 - protein, 123 aa, Artificial Sequence
  Description of Artificial Sequence: Synthetic polypeptide
QVHLSQSGAAVTKPGASVRVSCEASGYKIRDHFIHWWRQAPGQGLQWVGWINPKTGQPNNPRQFQGRVSLTRHASFDFDTFSFYMDLKAVRSDDTAIYFCARQRSDYWDFDVWGSGTQVTVSS

SEQ ID NO: 479 - protein, 99 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYNLTINNLQPEDVATYFCQVYEFIVPGTRLDLK

SEQ ID NO: 480 - protein, 99 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYNLTINNLQPEDVATYFCQVYEFFGPGTRLDLK

SEQ ID NO: 481 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYILTINNLQPEDIATYFCQVYEFVVPGTRLDLK

SEQ ID NO: 482 - protein, 99 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRWGQEYILTINNLQPEDVATYFCQVYEFIVPGTRLDLK

SEQ ID NO: 483 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYILTINNLQPEDIATYFCQVYEFVVPGTRLDLK

SEQ ID NO: 484 - protein, 99 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYILTINNLQPEDVATYFCQVYEFIVPGTRLDLK

SEQ ID NO: 485 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYILTINNLQPEDIATYFCQVYEFFGPGTRLDLK

SEQ ID NO: 486 - protein, 99 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYILTINNLQPEDVATYFCQVYEFFGPGTRLDLK

SEQ ID NO: 487 - protein, 99 aa, Artificial Sequence
  Description of Artificial Sequence: Synthetic polypeptide
DIQMTQSPSSLSASVGDRATITCQANGYLNWYQQRRGKAPKLLIYDGSKLERGVPSRFSGSRWGQEYILTISSLQPEDIATYFCQVYEFFGPGTRLDLK

SEQ ID NO: 488 - protein, 99 aa, Artificial Sequence
  Description of Artificial Sequence: Synthetic polypeptide
DIQMTQSPSSLSARVGDRATITCQANGYLNWYQQRRGKAPKLLIYDGSKLERGVPARFSGSRWGQEYILTISSLQPEDVATYFCQVYEFFGPGTRLDLK

SEQ ID NO: 489 - protein, 99 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRWGQEYTLTINNLQPEDVATYFCQVYEFIVPGTRLDLK

SEQ ID NO: 490 - skipped

SEQ ID NO: 491 - protein, 99 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYTLTINNLQPEDVATYFCQVYEFIVPGTRLDLK

SEQ ID NO: 492 - protein, 99 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYTLTINNLQPEDVATYFCQVYEFFGPGTRLDLK

SEQ ID NO: 493 - protein, 99 aa, Artificial Sequence
  Description of Artificial Sequence: Synthetic polypeptide
DIQMTQSPSSLSASVGDRATITCQANGYLNWYQQRRGKAPKLLIYDGSKLERGVPSRFSGSRWGQEYTLTISSLQPEDIATYFCQVYEFFGPGTRLDLK

SEQ ID NO: 494 - protein, 99 aa, Artificial Sequence
  Description of Artificial Sequence: Synthetic polypeptide
DIQMTQSPSSLSARVGDRATITCQANGYLNWYQQRRGKAPKLLIYDGSKLERGVPARFSGSRWGQEYTLTISSLQPEDVATYFCQVYEFFGPGTRLDLK

SEQ ID NO: 495 - protein, 99 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYHLTINNLQPEDVATYFCQVYEFIVPGTRLDLK

SEQ ID NO: 496 - protein, 99 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYHLTINNLQPEDVATYFCQVYEFFGPGTRLDLK

SEQ ID NO: 497 - protein, 99 aa, Artificial Sequence
  Description of Artificial Sequence: Synthetic polypeptide
DIQMTQSPSSLSARVGDRATITCQANGYLNWYQQRRGKAPKLLIYDGSKLERGVPARFSGSRWGQEYHLTISSLQPEDVATYFCQVYEFFGPGTRLDLK

SEQ ID NO: 498 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQDYILTINNLQPEDIATYFCQVYEFVVPGTRLDLK

SEQ ID NO: 499 - protein, 99 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQDYILTINNLQPEDVATYFCQVYEFIVPGTRLDLK

SEQ ID NO: 500 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRFGQEYILTINNLQPEDIATYFCQVYEFVVPGTRLDLK

SEQ ID NO: 501 - protein, 99 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRFGQEYILTINNLQPEDVATYFCQVYEFIVPGTRLDLK

SEQ ID NO: 502 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYVLTINNLQPEDIATYFCQVYEFVVPGTRLDLK

SEQ ID NO: 503 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYLLTINNLQPEDIATYFCQVYEFVVPGTRLDLK

SEQ ID NO: 504 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYMLTINNLQPEDIATYFCQVYEFVVPGTRLDLK

SEQ ID NO: 505 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYALTINNLQPEDIATYFCQVYEFVVPGTRLDLK

SEQ ID NO: 506 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYSLTINNLQPEDIATYFCQVYEFVVPGTRLDLK

SEQ ID NO: 507 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYFLTINNLQPEDIATYFCQVYEFVVPGTRLDLK

SEQ ID NO: 508 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGTRWGQEYILTINNLQPEDIATYFCQVYEFVVPGTRLDLK

SEQ ID NO: 509 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRRGQEYILTINNLQPEDIATYFCQVYEFVVPGTRLDLK

SEQ ID NO: 510 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRYGQEYILTINNLQPEDIATYFCQVYEFVVPGTRLDLK

SEQ ID NO: 511 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGTRWGQDYILTINNLQPEDIATYFCQVYEFVVPGTRLDLK

SEQ ID NO: 512 - protein, 99 aa, Artificial Sequence
  Description of Artificial Sequence: Synthetic polypeptide
DIQMTQSPSSLSARVGDTVTITCQANGYLNWYQQRRGKAPKLLIYDGSKLERGVPSRFSGRRWGQEYNLTINNLQPEDIATYFCQVYEFVVPGTRLDLK

SEQ ID NO: 513 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPARFSGRRWGQEYNLTINNLQPEDIATYFCQVYEFVVPGTRLDLK

SEQ ID NO: 514 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDVATYFCQVYEFVVPGTRLDLK

SEQ ID NO: 515 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFIVPGTRLDLK

SEQ ID NO: 516 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYTLTINNLQPEDIATYFCQVYEFFGPGTRLDLK

SEQ ID NO: 517 - protein, 453 aa, Artificial Sequence
  Description of Artificial Sequence: Synthetic polypeptide
QVHLSQSGAAVTKPGASVRVSCEASGYKIRDHFIHWWRQAPGQGLQWVGWINPKTGQPNNPRQFQGRVSLTRHASWDFDTFSFYMDLKAVRSDDTAIYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 518 - protein, 453 aa, Artificial Sequence
  Description of Artificial Sequence: Synthetic polypeptide
QVHLSQSGAAVTKPGASVRVSCEASGYNIRDYFIHWWRQAPGQGLQWVGWINPKTGQPNNPRQFQGRVSLTRHASWDFDTFSFYMDLKAVRSDDTAIYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 519 - protein, 453 aa, Artificial Sequence
  Description of Artificial Sequence: Synthetic polypeptide
QVHLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 520 - protein, 453 aa, Artificial Sequence
  Description of Artificial Sequence: Synthetic polypeptide
QVQLSQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 521 - protein, 453 aa, Artificial Sequence
  Description of Artificial Sequence: Synthetic polypeptide
QVQLLQSGAAVTKPGASVRVSCEASGYKIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 522 - protein, 453 aa, Artificial Sequence
  Description of Artificial Sequence: Synthetic polypeptide
QVQLLQSGAAVTKPGASVRVSCEASGYNISDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 523 - protein, 453 aa, Artificial Sequence
  Description of Artificial Sequence: Synthetic polypeptide
QVQLLQSGAAVTKPGASVRVSCEASGYNIRDHFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 524 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRQASWDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 525 - skipped

SEQ ID NO: 526 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKAVRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 527 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAIYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 528 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDFWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 529 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASFDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 530 - protein, 453 aa, Artificial Sequence
  Description of Artificial Sequence: Synthetic polypeptide
QVHLSQSGAAVTKPGASVRVSCEASGYKIRDHFIHWWRQAPGQGLQWVGWINPKTGQPNNPRQFQGRVSLTRHASFDFDTFSFYMDLKAVRSDDTAIYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 531 - protein, 206 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYNLTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 532 - protein, 206 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYNLTINNLQPEDVATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 533 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYILTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 534 - protein, 206 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRWGQEYILTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 535 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYILTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 536 - protein, 206 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYILTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 537 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYILTINNLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 538 - protein, 206 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYILTINNLQPEDVATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 539 - protein, 206 aa, Artificial Sequence
  Description of Artificial Sequence: Synthetic polypeptide
DIQMTQSPSSLSASVGDRATITCQANGYLNWYQQRRGKAPKLLIYDGSKLERGVPSRFSGSRWGQEYILTISSLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 540 - protein, 206 aa, Artificial Sequence
  Description of Artificial Sequence: Synthetic polypeptide
DIQMTQSPSSLSARVGDRATITCQANGYLNWYQQRRGKAPKLLIYDGSKLERGVPARFSGSRWGQEYILTISSLQPEDVATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 541 - protein, 206 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRWGQEYTLTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 542 - protein, 206 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYTLTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 543 - protein, 206 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYTLTINNLQPEDVATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 544 - protein, 206 aa, Artificial Sequence
  Description of Artificial Sequence: Synthetic polypeptide
DIQMTQSPSSLSASVGDRATITCQANGYLNWYQQRRGKAPKLLIYDGSKLERGVPSRFSGSRWGQEYTLTISSLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 545 - protein, 206 aa, Artificial Sequence
  Description of Artificial Sequence: Synthetic polypeptide
DIQMTQSPSSLSARVGDRATITCQANGYLNWYQQRRGKAPKLLIYDGSKLERGVPARFSGSRWGQEYTLTISSLQPEDVATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 546 - protein, 206 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYHLTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 547 - protein, 206 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQEYHLTINNLQPEDVATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 548 - protein, 206 aa, Artificial Sequence
  Description of Artificial Sequence: Synthetic polypeptide
DIQMTQSPSSLSARVGDRATITCQANGYLNWYQQRRGKAPKLLIYDGSKLERGVPARFSGSRWGQEYHLTISSLQPEDVATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 549 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQDYILTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 550 - protein, 206 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRWGQDYILTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 551 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRFGQEYILTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 552 - protein, 206 aa, Artificial Sequence
  Description of Artificial Sequence: Synthetic polypeptide
DIQMTQSPSSLSARVGDTATITCQANGYLNWYQQRRGKAPKLLIYDGSKLERGVPARFSGRRFGQEYILTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 553 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYVLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 554 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYLLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 555 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYMLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 556 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYALTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 557 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYSLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 558 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYFLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 559 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGTRWGQEYILTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 560 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRRGQEYILTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 561 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRYGQEYILTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 562 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGTRWGQDYILTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 563 - protein, 206 aa, Artificial Sequence
  Description of Artificial Sequence: Synthetic polypeptide
DIQMTQSPSSLSARVGDTVTITCQANGYLNWYQQRRGKAPKLLIYDGSKLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 564 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPARFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 565 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDVATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 566 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 567 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYTLTINNLQPEDIATYFCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 568 - protein, 206 aa, Artificial Sequence
  Description of Artificial Sequence: Synthetic polypeptide
DIQMTQSPSSLSASVGDTVTITCQATGYLNWYQQRRGKAPKLLIYDGSKLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 569 - protein, 99 aa, Artificial Sequence
  Description of Artificial Sequence: Synthetic polypeptide
DIQMTQSPSSLSASVGDTVTITCQATGYLNWYQQRRGKAPKLLIYDGSKLERGVPSRFSGRRWGQEYNLTINNLQPEDIATYFCQVYEFVVPGTRLDLK

SEQ ID NO: 570 - protein, 7 aa, Artificial Sequence
  Description of Artificial Sequence: Synthetic peptide
QATGYLN

SEQ ID NO: 571 - protein, 511 aa, Human immunodeficiency virus 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKR

SEQ ID NO: 572 - DNA, 369 bp, Artificial Sequence
  Description of Artificial Sequence: Synthetic polynucleotide
caggtgcagttgttgcagtctggcgccgctgttacaaagcctggcgcttctgttagagtgtcctgcgaggcctccggctacaacatcagagactacttcatccactggtggcggcaggctccaggacagggattgcaatgggtcggatggatcaaccctaagaccggccagcctaacaaccctagacagttccagggcagagtgtccctgaccagacacgcctcttgggacttcgacaccttcagcttctacatggacctgaaggccctgagatccgacgataccgccgtgtacttctgcgccagacagagaagcgactactgggatttcgatgtgtggggctctggcacccaagtgaccgtgtcctct

SEQ ID NO: 573 - DNA, 369 bp, Artificial Sequence
  Description of Artificial Sequence: Synthetic polynucleotide
caggtgcagctgctgcagtctggcgccgctgtgacaaaaccaggcgcttctgtgcgggtgtcctgcgaggccagcggctacaacatccgggactacttcattcactggtggcgccaggcccctggacagggactgcagtgggtgggatggatcaaccccaagaccggccagcccaacaaccccagacagttccagggcagagtgtccctgaccagacacgccagctgggacttcgacaccttcagcttctacatggacctgaaggccctgcggagcgacgataccgccgtgtacttctgcgccagacagagaagcgactactgggatttcgacgtgtggggcagcggcacccaagtgaccgtgtcatct

SEQ ID NO: 574 - DNA, 369 bp, Artificial Sequence
  Description of Artificial Sequence: Synthetic polynucleotide
caggtgcagttgttgcagtctggcgccgctgttacaaagcctggcgcttctgttagagtgtcctgcgaggcctccggctacaacatcagagactacttcatccactggtggcggcaggctccaggacagggattgcaatgggtcggatggatcaaccctaagaccggccagcctaacaaccctagacagttccagggcagagtgtccctgaccagacacgcctctttcgacttcgacaccttcagcttctacatggacctgaaggccctgagatccgacgataccgccgtgtacttctgcgccagacagagaagcgactactgggacttcgatgtgtggggctctggcacccaagtgaccgtgtcctct

SEQ ID NO: 575 - DNA, 369 bp, Artificial Sequence
  Description of Artificial Sequence: Synthetic polynucleotide
caggtgcagctgctgcagtctggcgccgctgtgacaaaaccaggcgcttctgtgcgggtgtcctgcgaggccagcggctacaacatccgggactacttcattcactggtggcgccaggcccctggacagggactgcagtgggtgggatggatcaaccccaagaccggccagcccaacaaccccagacagttccagggcagagtgtccctgaccagacacgccagcttcgacttcgacaccttcagcttctacatggacctgaaggccctgcggagcgacgataccgccgtgtacttctgcgccagacagagaagcgactactgggatttcgacgtgtggggcagcggcacccaagtgaccgtgtcatct

SEQ ID NO: 576 - DNA, 369 bp, Artificial Sequence
  Description of Artificial Sequence: Synthetic polynucleotide
caggtccacttgtctcaatctggcgccgctgtgacaaagcctggcgcttctgtcagagtgtcttgcgaggcctctggctacaagatccgggaccactttatccactggtggcgacaggctccaggacagggattgcagtgggtcggatggatcaaccctaagaccggccagcctaacaaccctagacagttccagggcagagtgtccctgaccagacacgcctcttgggacttcgacaccttcagcttctacatggacctgaaggccgtgcggagcgacgacaccgctatctacttttgcgccagacagagatccgactactgggatttcgatgtgtggggctctggcacccaagtgaccgtgtcctct

SEQ ID NO: 577 - DNA, 369 bp, Artificial Sequence
  Description of Artificial Sequence: Synthetic polynucleotide
caggtccacctgtctcaatctggcgccgctgttacaaaaccaggcgcctctgttagagtgtcttgcgaggccagcggctacaagatcagggaccactttattcactggtggcgccaggctccaggacagggacttcaatgggtcggatggatcaaccctaagaccggccagcctaacaaccccagacagttccagggcagagtgtctctgacaagacacgccagctgggacttcgacaccttcagcttctacatggacctgaaggccgtgcggagcgacgacaccgccatctatttttgcgccagacagagaagcgactactgggatttcgatgtgtggggcagcggcacccaagtgacagtctcttct

SEQ ID NO: 578 - DNA, 369 bp, Artificial Sequence
  Description of Artificial Sequence: Synthetic polynucleotide
caggtccacttgtctcaatctggcgccgctgtgacaaagcctggcgcttctgtcagagtgtcttgcgaggcctctggctacaagatccgggaccactttatccactggtggcgacaggctccaggacagggattgcagtgggtcggatggatcaaccctaagaccggccagcctaacaaccctagacagttccagggcagagtgtccctgaccagacacgcctctttcgacttcgacaccttcagcttctacatggacctgaaggccgtgcggagcgacgacaccgctatctacttttgcgccagacagagatccgactactgggacttcgatgtgtggggctctggcacccaagtgaccgtgtcctct

SEQ ID NO: 579 - DNA, 369 bp, Artificial Sequence
  Description of Artificial Sequence: Synthetic polynucleotide
caggtccacctgtctcaatctggcgccgctgttacaaaaccaggcgcctctgttagagtgtcttgcgaggccagcggctacaagatcagggaccactttattcactggtggcgccaggctccaggacagggacttcaatgggtcggatggatcaaccctaagaccggccagcctaacaaccccagacagttccagggcagagtgtctctgacaagacacgccagcttcgacttcgacaccttcagcttctacatggacctgaaggccgtgcggagcgacgacaccgccatctatttttgcgccagacagagaagcgactactgggatttcgatgtgtggggcagcggcacccaagtgacagtctcttct

SEQ ID NO: 580 - DNA, 369 bp, Artificial Sequence
  Description of Artificial Sequence: Synthetic polynucleotide
caggtccacttgtctcaatctggcgccgctgtgacaaagcctggcgcttctgtcagagtgtcttgcgaggcctccggctacaacatccgggactactttatccactggtggcggcaggctccaggacagggattgcaatgggtcggatggatcaaccctaagaccggccagcctaacaaccctagacagttccagggcagagtgtccctgaccagacacgcctcttgggacttcgacaccttcagcttctacatggacctgaaggccgtgcggagcgacgacaccgctatctacttttgcgccagacagagatccgactactgggatttcgatgtgtggggctctggcacccaagtgaccgtgtcctct

SEQ ID NO: 581 - DNA, 369 bp, Artificial Sequence
  Description of Artificial Sequence: Synthetic polynucleotide
caggtccacctgtctcaatctggcgccgctgttacaaaaccaggcgcctctgttagagtgtcttgcgaggccagcggctacaacatccgggactactttattcactggtggcgccaggctccaggacagggacttcaatgggtcggatggatcaaccctaagaccggccagcctaacaaccccagacagttccagggcagagtgtctctgacaagacacgccagctgggacttcgacaccttcagcttctacatggacctgaaggccgtgcggagcgacgacaccgccatctatttttgcgccagacagagaagcgactactgggatttcgatgtgtggggcagcggcacccaagtgacagtctcttct

SEQ ID NO: 582 - DNA, 297 bp, Artificial Sequence
  Description of Artificial Sequence: Synthetic polynucleotide
gacatccagatgacccagagcccttcctctttatccgctagcgtcggcgataccgtgaccatcacatgccaagctaacggctacctcaactggtaccagcagcggaggggaaaggcccccaagctgctgatctacgacggctccaagctggagaggggagtgccttcccggttcagcggaaggaggtggggacaagaatacaatttaaccatcaacaatttacagcccgaggacatcgctacctacttctgccaagtttacgagttcgtggtgcccggcactcgtctggatctgaag

SEQ ID NO: 583 - DNA, 297 bp, Artificial Sequence
  Description of Artificial Sequence: Synthetic polynucleotide
gacatccagatgacccagagccctagcagcctgagcgccagcgtgggcgataccgtgaccattacctgccaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctgcagcccgaggatatcgccacatacttttgccaggtgtacgagttcgtggtgcccggcacacggctggacctgaaa

SEQ ID NO: 584 - DNA, 297 bp, Artificial Sequence
  Description of Artificial Sequence: Synthetic polynucleotide
gacatccagatgacccagtctccatcctctctgtctgcctctgtgggcgataccgctaccatcacctgtcaggccaacggctacctgaactggtatcagcagagaagaggcaaggcccctaagctgctgatctacgacggctccaaactggaaagaggcgtgccctctcggttctctggcagaagatggggccaagagtacaacctgaccatcaacaacctgcagcctgaggatatcgccacatacttttgccaggtgtacgagttcgtggtgcctggcacaagactggacctgaag

SEQ ID NO: 585 - DNA, 297 bp, Artificial Sequence
  Description of Artificial Sequence: Synthetic polynucleotide
gatattcagatgacacagagccccagtagcctgagcgccagcgtgggcgacaccgcaaccatcacctgtcaggccaacggctatctgaactggtatcaacagaggaggggcaaggcccccaagctcctgatatacgacggcagcaagctggagaggggcgttcccagccgcttcagcggcaggaggtggggccaggagtacaaccttacaatcaacaacctgcagcccgaggacatcgccacctatttctgccaagtttacgagttcgtggtgcccggcaccaggctggacctgaag

SEQ ID NO: 586 - DNA, 297 bp, Artificial Sequence
  Description of Artificial Sequence: Synthetic polynucleotide
gacatccagatgacccagtctccatcctctctgtctgcctctgtgggcgacagagctaccatcacctgtcaggccaacggctacctgaactggtatcagcagagaagaggcaaggcccctaagctgctgatctacgacggctccaaactggaaagaggcgtgccctccagattctccggctctagatggggccaagagtacaacctgaccatctccagcctccagcctgaggatatcgccacatacttttgccaggtgtacgagttcttcggccctggcaccagactggacctgaag

SEQ ID NO: 587 - DNA, 297 bp, Artificial Sequence
  Description of Artificial Sequence: Synthetic polynucleotide
gatattcagatgacacagagccccagtagcctgagcgccagcgtgggcgacagagcaaccatcacctgtcaggccaacggctatctgaactggtatcaacagagaaggggcaaggcccccaagctcctgatatacgacggcagcaagctggagaggggcgttcccagccgcttcagcggctcaaggtggggccaggagtacaaccttacaatctcatccctgcagcccgaggacatcgccacctatttctgccaagtttacgagttcttcggacccggcaccaggctggacctgaag

SEQ ID NO: 588 - DNA, 297 bp, Artificial Sequence
  Description of Artificial Sequence: Synthetic polynucleotide
gacatccagatgacccagtctccatcctctctgtctgccagagtgggcgacaccgtgacaatcacctgtcaggccaacggctacctgaactggtatcagcagagaagaggcaaggcccctaagctgctgatctacgacggctccaaactggaaagaggcgtgcccgctagattctccggcagaagatggggccaagagtacaacctgaccatcaacaacctgcagcctgaggacgtggccacatacttttgccaggtgtacgagttcatcgtgcccggcaccagactggacctgaag

SEQ ID NO: 589 - DNA, 297 bp, Artificial Sequence
  Description of Artificial Sequence: Synthetic polynucleotide
gatattcagatgacacagagccccagtagcctgagcgcccgcgtgggcgacaccgtgaccatcacctgtcaggccaacggctatctgaactggtatcaacagaggaggggcaaggcccccaagctcctgatatacgacggcagcaagctggagaggggcgttcccgcacgcttcagcggcaggaggtggggccaggagtacaaccttacaatcaacaacctgcagcccgaggacgtcgccacctatttctgccaagtttacgagttcatcgtgcccggcaccaggctggacctgaag

SEQ ID NO: 590 - DNA, 297 bp, Artificial Sequence
  Description of Artificial Sequence: Synthetic polynucleotide
gacatccagatgacccagtctccatcctctctgtctgcctctgtgggcgataccgctaccatcacctgtcaggccaacggctacctgaactggtatcagcagagaagaggcaaggcccctaagctgctgatctacgacggctccaaactggaaagaggcgtgccctctcggttctctggcagaagatggggccaagagtacaccctgaccatcaacaacctgcagcctgaggatatcgccacatacttttgccaggtgtacgagttcttcggccctggcaccagactggacctgaag

SEQ ID NO: 591 - DNA, 297 bp, Artificial Sequence
  Description of Artificial Sequence: Synthetic polynucleotide
gacatccagatgacacagagccctagcagcctgtctgccagcgtgggagataccgccacaattacctgtcaggccaacggctacctgaactggtatcagcagcggagaggcaaggcccctaagctgctgatctacgacggcagcaagctggaaagaggcgtgcccagcagattcagcggcagaagatggggccaagagtacaccctgaccatcaacaacctgcagcctgaggatattgccacatacttttgccaggtgtacgagttcttcggccctggcaccagactggacctgaag

SEQ ID NO: 592 - DNA, 297 bp, Artificial Sequence
  Description of Artificial Sequence: Synthetic polynucleotide
gacatccagatgacccagtctccatcctctctgtctgcctctgtgggcgacagagctaccatcacctgtcaggccaacggctacctgaactggtatcagcagagaagaggcaaggcccctaagctgctgatctacgacggctccaaactggaaagaggcgtgccctccagattctccggctctagatggggccaagagtacaccctgaccatctctagcctgcagcctgaggatatcgccacatacttttgccaggtgtacgagttcttcggccctggcaccagactggacctgaag

SEQ ID NO: 593 - DNA, 297 bp, Artificial Sequence
  Description of Artificial Sequence: Synthetic polynucleotide
gacatccagatgacacagagccctagcagcctgtctgcctctgtgggcgatagagccacaatcacctgtcaggccaacggctacctgaactggtatcagcagagaagaggcaaggcccctaagctgctgatctacgacggcagcaaactggaaagaggcgtgccaagcagattcagcggctctagatggggccaagagtacaccctgaccatctctagcctgcagcctgaggatatcgccacatacttttgccaggtgtacgagttcttcggccctggcaccagactggacctgaaa

SEQ ID NO: 594 - DNA, 297 bp, Artificial Sequence
  Description of Artificial Sequence: Synthetic polynucleotide
gacatccagatgacccagtctccatcctctctgtctgccagagtgggcgataccgctaccatcacctgtcaggccaacggctacctgaactggtatcagcagagaagaggcaaggcccctaagctgctgatctacgacggctccaaactggaaagaggcgtgcccgctagattctccggcagaagatggggccaagagtacaccctgaccatcaacaacctgcagcctgaggacgtggccacatacttttgccaggtgtacgagttcatcgtgcccggcaccagactggacctgaag

SEQ ID NO: 595 - DNA, 297 bp, Artificial Sequence
  Description of Artificial Sequence: Synthetic polynucleotide
gatattcagatgacacagagccccagtagcctgagcgcccgcgtgggcgacaccgcgaccatcacctgtcaggccaacggctatctgaactggtatcaacagaggaggggcaaggcccccaagctcctgatatacgacggcagcaagctggagaggggcgttcccgcacgcttcagcggcaggaggtggggccaggagtacacccttacaatcaacaacctgcagcccgaggacgtcgccacctatttctgccaagtttacgagttcatcgtgcccggcaccaggctggacctgaag

SEQ ID NO: 596 - DNA, 1359 bp, Artificial Sequence
  Description of Artificial Sequence: Synthetic polynucleotide
caggtgcagttgttgcagtctggcgccgctgttacaaagcctggcgcttctgttagagtgtcctgcgaggcctccggctacaacatcagagactacttcatccactggtggcggcaggctccaggacagggattgcaatgggtcggatggatcaaccctaagaccggccagcctaacaaccctagacagttccagggcagagtgtccctgaccagacacgcctcttgggacttcgacaccttcagcttctacatggacctgaaggccctgagatccgacgataccgccgtgtacttctgcgccagacagagaagcgactactgggatttcgatgtgtggggctctggcacccaagtgaccgtgtcctctgcttctaccaagggaccctctgtgttccctctggctccttccagcaagtctacctctggtggaaccgctgctctgggctgcctggtcaaggattactttcctgagcctgtgacagtgtcctggaactctggtgctctgacctccggcgtgcacacatttccagctgtgctgcagtcctccggcctgtactctctgtcctctgtcgtgaccgtgccttctagctctctgggcacccagacctacatctgcaacgtgaaccacaagccttccaacaccaaggtggacaagaaggtggaacccaagtcctgcgacaagacccacacctgtcctccatgtcctgctccagaactgctggctggccccgatgtctttctgttccctccaaagcctaaggacaccctgatgatctctcggacccctgaagtgacctgcgtggtggtggatgtgtctcacgaggatcccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctctgcctgaggaaaagaccatctctaaggctaagggccagcctcgcgagcctcaggtttacacactgcctccatctcgggaagagatgaccaagaaccaggtgtcactgacctgcctcgtgaagggcttctacccttccgatatcgccgtggaatgggagtccaatggccagcctgagaacaactacaagacaacccctcctgtgctggactccgacggctcattcttcctgtactccaagctgacagtggacaagtctcggtggcagcagggcaacgtgttctcttgtagtgtgctgcacgaggccctgcactcccactatacccagaagtctctgtctctgagccccggcaaa

SEQ ID NO: 597 - DNA, 1359 bp, Artificial Sequence
  Description of Artificial Sequence: Synthetic polynucleotide
caggtgcagctgctgcagtctggcgccgctgtgacaaaaccaggcgcttctgtgcgggtgtcctgcgaggccagcggctacaacatccgggactacttcattcactggtggcgccaggcccctggacagggactgcagtgggtgggatggatcaaccccaagaccggccagcccaacaaccccagacagttccagggcagagtgtccctgaccagacacgccagctgggacttcgacaccttcagcttctacatggacctgaaggccctgcggagcgacgataccgccgtgtacttctgcgccagacagagaagcgactactgggatttcgacgtgtggggcagcggcacccaagtgaccgtgtcatctgctagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctggctggccctgacgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcccctgcccgaggaaaagaccatctctaaggccaagggacagccccgcgagccccaggtgtacacactgcctccaagccgggaagagatgaccaagaaccaggtgtccctgacctgtctcgtgaaaggcttctaccccagcgacattgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgtagcgtgttgcatgaggctctgcacagccactacacgcagaagagcctctccctgtctccgggtaaa

SEQ ID NO: 598 - DNA, 1359 bp, Artificial Sequence
  Description of Artificial Sequence: Synthetic polynucleotide
caggtgcagttgttgcagtctggcgccgctgttacaaagcctggcgcttctgttagagtgtcctgcgaggcctccggctacaacatcagagactacttcatccactggtggcggcaggctccaggacagggattgcaatgggtcggatggatcaaccctaagaccggccagcctaacaaccctagacagttccagggcagagtgtccctgaccagacacgcctctttcgacttcgacaccttcagcttctacatggacctgaaggccctgagatccgacgataccgccgtgtacttctgcgccagacagagaagcgactactgggacttcgatgtgtggggctctggcacccaagtgaccgtgtcctctgcttctaccaagggaccctctgtgttccctctggctccttccagcaagtctacctctggtggaaccgctgctctgggctgcctggtcaaggattactttcctgagcctgtgacagtgtcctggaactctggtgctctgacctccggcgtgcacacatttccagctgtgctgcagtcctccggcctgtactctctgtcctctgtcgtgaccgtgccttctagctctctgggcacccagacctacatctgcaacgtgaaccacaagccttccaacaccaaggtggacaagaaggtggaacccaagtcctgcgacaagacccacacctgtcctccatgtcctgctccagaactgctggctggccccgatgtctttctgttccctccaaagcctaaggacaccctgatgatctctcggacccctgaagtgacctgcgtggtggtggatgtgtctcacgaggatcccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctctgcctgaggaaaagaccatctctaaggctaagggccagcctcgcgagcctcaggtttacacactgcctccatctcgggaagagatgaccaagaaccaggtgtcactgacctgcctcgtgaagggcttctacccttccgatatcgccgtggaatgggagtccaatggccagcctgagaacaactacaagacaacccctcctgtgctggactccgacggctcattcttcctgtactccaagctgacagtggacaagtctcggtggcagcagggcaacgtgttctcttgtagtgtgctgcacgaggccctgcactcccactatacccagaagtctctgtctctgagccccggcaaa

SEQ ID NO: 599 - DNA, 1359 bp, Artificial Sequence
  Description of Artificial Sequence: Synthetic polynucleotide
caggtgcagctgctgcagtctggcgccgctgtgacaaaaccaggcgcttctgtgcgggtgtcctgcgaggccagcggctacaacatccgggactacttcattcactggtggcgccaggcccctggacagggactgcagtgggtgggatggatcaaccccaagaccggccagcccaacaaccccagacagttccagggcagagtgtccctgaccagacacgccagcttcgacttcgacaccttcagcttctacatggacctgaaggccctgcggagcgacgataccgccgtgtacttctgcgccagacagagaagcgactactgggatttcgacgtgtggggcagcggcacccaagtgaccgtgtcatctgctagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctggctggccctgacgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcccctgcccgaggaaaagaccatctctaaggccaagggacagccccgcgagccccaggtgtacacactgcctccaagccgggaagagatgaccaagaaccaggtgtccctgacctgtctcgtgaaaggcttctaccccagcgacattgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgtagcgtgttgcatgaggctctgcacagccactacacgcagaagagcctctccctgtctccgggtaaa

SEQ ID NO: 600 - DNA, 1359 bp, Artificial Sequence
  Description of Artificial Sequence: Synthetic polynucleotide
caggtccacttgtctcaatctggcgccgctgtgacaaagcctggcgcttctgtcagagtgtcttgcgaggcctctggctacaagatccgggaccactttatccactggtggcgacaggctccaggacagggattgcagtgggtcggatggatcaaccctaagaccggccagcctaacaaccctagacagttccagggcagagtgtccctgaccagacacgcctcttgggacttcgacaccttcagcttctacatggacctgaaggccgtgcggagcgacgacaccgctatctacttttgcgccagacagagatccgactactgggatttcgatgtgtggggctctggcacccaagtgaccgtgtcctctgcttctaccaagggaccctctgtgttccctctggctccttccagcaagtctacctctggtggaaccgctgctctgggctgcctggtcaaggattactttcctgagcctgtgacagtgtcctggaactctggtgctctgacctccggcgtgcacacatttccagctgtgctgcagtcctccggcctgtactctctgtcctctgtcgtgaccgtgccttctagctctctgggcacccagacctacatctgcaacgtgaaccacaagccttccaacaccaaggtggacaagaaggtggaacccaagtcctgcgacaagacccacacctgtcctccatgtcctgctccagaactgctggctggccccgatgtctttctgttccctccaaagcctaaggacaccctgatgatctctcggacccctgaagtgacctgcgtggtggtggatgtgtctcacgaggatcccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctctgcctgaggaaaagaccatctctaaggctaagggccagcctcgcgagcctcaggtttacacactgcctccatctcgggaagagatgaccaagaaccaggtgtcactgacctgcctcgtgaagggcttctacccttccgatatcgccgtggaatgggagtccaatggccagcctgagaacaactacaagacaacccctcctgtgctggactccgacggctcattcttcctgtactccaagctgacagtggacaagtctcggtggcagcagggcaacgtgttctcttgtagtgtgctgcacgaggccctgcactcccactatacccagaagtccctgtctctgtcccctggcaaa

SEQ ID NO: 601 - DNA, 1359 bp, Artificial Sequence
  Description of Artificial Sequence: Synthetic polynucleotide
caggtccacctgtctcaatctggcgccgctgttacaaaaccaggcgcctctgttagagtgtcttgcgaggccagcggctacaagatcagggaccactttattcactggtggcgccaggctccaggacagggacttcaatgggtcggatggatcaaccctaagaccggccagcctaacaaccccagacagttccagggcagagtgtctctgacaagacacgccagctgggacttcgacaccttcagcttctacatggacctgaaggccgtgcggagcgacgacaccgccatctatttttgcgccagacagagaagcgactactgggatttcgatgtgtggggcagcggcacccaagtgacagtctcttctgctagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctggctggccctgacgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcccctgcccgaggaaaagaccatctctaaggccaagggacagccccgcgagccccaggtgtacacactgcctccaagccgggaagagatgaccaagaaccaggtgtccctgacctgtctcgtgaaaggcttctaccccagcgacattgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgtagcgtgttgcatgaggctctgcacagccactacacgcagaagagcctctccctgtctccgggtaaa

SEQ ID NO: 602 - DNA, 1359 bp, Artificial Sequence
  Description of Artificial Sequence: Synthetic polynucleotide
caggtccacttgtctcaatctggcgccgctgtgacaaagcctggcgcttctgtcagagtgtcttgcgaggcctctggctacaagatccgggaccactttatccactggtggcgacaggctccaggacagggattgcagtgggtcggatggatcaaccctaagaccggccagcctaacaaccctagacagttccagggcagagtgtccctgaccagacacgcctctttcgacttcgacaccttcagcttctacatggacctgaaggccgtgcggagcgacgacaccgctatctacttttgcgccagacagagatccgactactgggacttcgatgtgtggggctctggcacccaagtgaccgtgtcctctgcttctaccaagggaccctctgtgttccctctggctccttccagcaagtctacctctggtggaaccgctgctctgggctgcctggtcaaggattactttcctgagcctgtgacagtgtcctggaactctggtgctctgacctccggcgtgcacacatttccagctgtgctgcagtcctccggcctgtactctctgtcctctgtcgtgaccgtgccttctagctctctgggcacccagacctacatctgcaacgtgaaccacaagccttccaacaccaaggtggacaagaaggtggaacccaagtcctgcgacaagacccacacctgtcctccatgtcctgctccagaactgctggctggccccgatgtctttctgttccctccaaagcctaaggacaccctgatgatctctcggacccctgaagtgacctgcgtggtggtggatgtgtctcacgaggatcccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctctgcctgaggaaaagaccatctctaaggctaagggccagcctcgcgagcctcaggtttacacactgcctccatctcgggaagagatgaccaagaaccaggtgtcactgacctgcctcgtgaagggcttctacccttccgatatcgccgtggaatgggagtccaatggccagcctgagaacaactacaagacaacccctcctgtgctggactccgacggctcattcttcctgtactccaagctgacagtggacaagtctcggtggcagcagggcaacgtgttctcttgtagtgtgctgcacgaggccctgcactcccactatacccagaagtccctgtctctgtcccctggcaaa

SEQ ID NO: 603 - DNA, 1359 bp, Artificial Sequence
  Description of Artificial Sequence: Synthetic polynucleotide
caggtccacctgtctcaatctggcgccgctgttacaaaaccaggcgcctctgttagagtgtcttgcgaggccagcggctacaagatcagggaccactttattcactggtggcgccaggctccaggacagggacttcaatgggtcggatggatcaaccctaagaccggccagcctaacaaccccagacagttccagggcagagtgtctctgacaagacacgccagcttcgacttcgacaccttcagcttctacatggacctgaaggccgtgcggagcgacgacaccgccatctatttttgcgccagacagagaagcgactactgggatttcgatgtgtggggcagcggcacccaagtgacagtctcttctgctagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctggctggccctgacgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcccctgcccgaggaaaagaccatctctaaggccaagggacagccccgcgagccccaggtgtacacactgcctccaagccgggaagagatgaccaagaaccaggtgtccctgacctgtctcgtgaaaggcttctaccccagcgacattgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgtagcgtgttgcatgaggctctgcacagccactacacgcagaagagcctctccctgtctccgggtaaa

SEQ ID NO: 604 - DNA, 1359 bp, Artificial Sequence
  Description of Artificial Sequence: Synthetic polynucleotide
caggtccacttgtctcaatctggcgccgctgtgacaaagcctggcgcttctgtcagagtgtcttgcgaggcctccggctacaacatccgggactactttatccactggtggcggcaggctccaggacagggattgcaatgggtcggatggatcaaccctaagaccggccagcctaacaaccctagacagttccagggcagagtgtccctgaccagacacgcctcttgggacttcgacaccttcagcttctacatggacctgaaggccgtgcggagcgacgacaccgctatctacttttgcgccagacagagatccgactactgggatttcgatgtgtggggctctggcacccaagtgaccgtgtcctctgcttctaccaagggaccctctgtgttccctctggctccttccagcaagtctacctctggtggaaccgctgctctgggctgcctggtcaaggattactttcctgagcctgtgacagtgtcctggaactctggtgctctgacctccggcgtgcacacatttccagctgtgctgcagtcctccggcctgtactctctgtcctctgtcgtgaccgtgccttctagctctctgggcacccagacctacatctgcaacgtgaaccacaagccttccaacaccaaggtggacaagaaggtggaacccaagtcctgcgacaagacccacacctgtcctccatgtcctgctccagaactgctggctggccccgatgtctttctgttccctccaaagcctaaggacaccctgatgatctctcggacccctgaagtgacctgcgtggtggtggatgtgtctcacgaggatcccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctctgcctgaggaaaagaccatctctaaggctaagggccagcctcgcgagcctcaggtttacacactgcctccatctcgggaagagatgaccaagaaccaggtgtcactgacctgcctcgtgaagggcttctacccttccgatatcgccgtggaatgggagtccaatggccagcctgagaacaactacaagacaacccctcctgtgctggactccgacggctcattcttcctgtactccaagctgacagtggacaagtctcggtggcagcagggcaacgtgttctcttgtagtgtgctgcacgaggccctgcactcccactatacccagaagtccctgtctctgtcccctggcaaa

SEQ ID NO: 605 - DNA, 1359 bp, Artificial Sequence
  Description of Artificial Sequence: Synthetic polynucleotide
caggtccacctgtctcaatctggcgccgctgttacaaaaccaggcgcctctgttagagtgtcttgcgaggccagcggctacaacatccgggactactttattcactggtggcgccaggctccaggacagggacttcaatgggtcggatggatcaaccctaagaccggccagcctaacaaccccagacagttccagggcagagtgtctctgacaagacacgccagctgggacttcgacaccttcagcttctacatggacctgaaggccgtgcggagcgacgacaccgccatctatttttgcgccagacagagaagcgactactgggatttcgatgtgtggggcagcggcacccaagtgacagtctcttctgctagcaccaagggccccagcgtgttccctctggcccctagcagcaagagcacatctggcggaacagccgccctgggctgcctcgtgaaggactactttcccgagcccgtgaccgtgtcctggaactctggcgctctgacaagcggcgtgcacacctttccagccgtgctgcagagcagcggcctgtactctctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctggctggccctgacgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagcctagagaggaacagtacaacagcacctaccgggtggtgtccgtgctgacagtgctgcaccaggactggctgaacggcaaagagtacaagtgcaaggtgtccaacaaggccctgcccctgcccgaggaaaagaccatctctaaggccaagggacagccccgcgagccccaggtgtacacactgcctccaagccgggaagagatgaccaagaaccaggtgtccctgacctgtctcgtgaaaggcttctaccccagcgacattgccgtggaatgggagagcaacggccagcccgagaacaactacaagaccaccccccctgtgctggacagcgacggctcattcttcctgtacagcaagctgaccgtggacaagtcccggtggcagcagggcaacgtgttcagctgtagcgtgttgcatgaggctctgcacagccactacacgcagaagagcctctccctgtctccgggtaaa

SEQ ID NO: 606 - DNA, 618 bp, Artificial Sequence
  Description of Artificial Sequence: Synthetic polynucleotide
gacatccagatgacccagagcccttcctctttatccgctagcgtcggcgataccgtgaccatcacatgccaagctaacggctacctcaactggtaccagcagcggaggggaaaggcccccaagctgctgatctacgacggctccaagctggagaggggagtgccttcccggttcagcggaaggaggtggggacaagaatacaatttaaccatcaacaatttacagcccgaggacatcgctacctacttctgccaagtttacgagttcgtggtgcccggcactcgtctggatctgaagaggaccgtggccgccccctccgtgttcatctttcccccttccgacgagcagctgaagtccggcaccgcctccgtggtgtgtttactgaacaacttctaccctcgtgaggccaaggtgcagtggaaggtggacaacgctttacagtccggcaactcccaagaatccgtgaccgagcaagatagcaaggactccacctactccctctccagcactttaactttatccaaggccgactacgagaagcacaaggtgtacgcttgtgaggtgacccaccaaggtctgtcctcccccgtgacaaagtccttcaatcggggcgagtgt

SEQ ID NO: 607 - DNA, 618 bp, Artificial Sequence
  Description of Artificial Sequence: Synthetic polynucleotide
gacatccagatgacccagagccctagcagcctgagcgccagcgtgggcgataccgtgaccattacctgccaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctgcagcccgaggatatcgccacatacttttgccaggtgtacgagttcgtggtgcccggcacacggctggacctgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 608 - DNA, 618 bp, Artificial Sequence
  Description of Artificial Sequence: Synthetic polynucleotide
gacatccagatgacccagtctccatcctctctgtctgcctctgtgggcgataccgctaccatcacctgtcaggccaacggctacctgaactggtatcagcagagaagaggcaaggcccctaagctgctgatctacgacggctccaaactggaaagaggcgtgccctctcggttctctggcagaagatggggccaagagtacaacctgaccatcaacaacctgcagcctgaggatatcgccacatacttttgccaggtgtacgagttcgtggtgcctggcacaagactggacctgaagagaaccgtggccgctccttccgtgttcatcttcccaccatctgacgagcagctgaagtctggcaccgcttctgtcgtgtgcctgctgaacaacttctaccctcgggaagccaaggtgcagtggaaggtggacaatgccctgcagtccggcaactcccaagagtctgtgaccgagcaggactccaaggactctacctacagcctgtcctccacactgaccctgtctaaggccgactacgagaagcacaaggtgtacgcctgcgaagtgacccatcagggactgtctagccccgtgaccaagtccttcaacagaggcgagtgt

SEQ ID NO: 609 - DNA, 618 bp, Artificial Sequence
  Description of Artificial Sequence: Synthetic polynucleotide
gatattcagatgacacagagccccagtagcctgagcgccagcgtgggcgacaccgcaaccatcacctgtcaggccaacggctatctgaactggtatcaacagaggaggggcaaggcccccaagctcctgatatacgacggcagcaagctggagaggggcgttcccagccgcttcagcggcaggaggtggggccaggagtacaaccttacaatcaacaacctgcagcccgaggacatcgccacctatttctgccaagtttacgagttcgtggtgcccggcaccaggctggacctgaagcggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgc

SEQ ID NO: 610 - DNA, 618 bp, Artificial Sequence
  Description of Artificial Sequence: Synthetic polynucleotide
gacatccagatgacccagtctccatcctctctgtctgcctctgtgggcgacagagctaccatcacctgtcaggccaacggctacctgaactggtatcagcagagaagaggcaaggcccctaagctgctgatctacgacggctccaaactggaaagaggcgtgccctccagattctccggctctagatggggccaagagtacaacctgaccatctccagcctccagcctgaggatatcgccacatacttttgccaggtgtacgagttcttcggccctggcaccagactggacctgaagagaacagtggccgctccttccgtgttcatcttcccaccatctgacgagcagctgaagtctggcaccgcttctgtcgtgtgcctgctgaacaacttctaccctcgggaagccaaggtgcagtggaaggtggacaatgctctccagtccggcaactcccaagagtctgtgaccgagcaggactccaaggactctacctacagcctgtcctccacactgaccctgtctaaggccgactacgagaagcacaaggtgtacgcctgcgaagtgacccatcagggactgtctagccccgtgaccaagtccttcaacagaggcgagtgt

SEQ ID NO: 611 - DNA, 618 bp, Artificial Sequence
  Description of Artificial Sequence: Synthetic polynucleotide
gatattcagatgacacagagccccagtagcctgagcgccagcgtgggcgacagagcaaccatcacctgtcaggccaacggctatctgaactggtatcaacagagaaggggcaaggcccccaagctcctgatatacgacggcagcaagctggagaggggcgttcccagccgcttcagcggctcaaggtggggccaggagtacaaccttacaatctcatccctgcagcccgaggacatcgccacctatttctgccaagtttacgagttcttcggacccggcaccaggctggacctgaagcggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgc

SEQ ID NO: 612 - DNA, 618 bp, Artificial Sequence
  Description of Artificial Sequence: Synthetic polynucleotide
gacatccagatgacccagtctccatcctctctgtctgccagagtgggcgacaccgtgacaatcacctgtcaggccaacggctacctgaactggtatcagcagagaagaggcaaggcccctaagctgctgatctacgacggctccaaactggaaagaggcgtgcccgctagattctccggcagaagatggggccaagagtacaacctgaccatcaacaacctgcagcctgaggacgtggccacatacttttgccaggtgtacgagttcatcgtgcccggcaccagactggacctgaagagaacagttgccgctccttccgtgttcatcttcccaccttccgacgagcagctgaagtctggcacagcttctgtcgtgtgcctgctgaacaacttctaccctcgggaagccaaggtgcagtggaaggtggacaatgccctgcagtccggcaactcccaagagtctgtgaccgagcaggactccaaggactctacctacagcctgtcctccacactgaccctgtctaaggccgactacgagaagcacaaggtgtacgcctgcgaagtgacccatcagggactgtctagccccgtgaccaagtccttcaacagaggcgagtgt

SEQ ID NO: 613 - DNA, 618 bp, Artificial Sequence
  Description of Artificial Sequence: Synthetic polynucleotide
gatattcagatgacacagagccccagtagcctgagcgcccgcgtgggcgacaccgtgaccatcacctgtcaggccaacggctatctgaactggtatcaacagaggaggggcaaggcccccaagctcctgatatacgacggcagcaagctggagaggggcgttcccgcacgcttcagcggcaggaggtggggccaggagtacaaccttacaatcaacaacctgcagcccgaggacgtcgccacctatttctgccaagtttacgagttcatcgtgcccggcaccaggctggacctgaagcggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgc

SEQ ID NO: 614 - DNA, 618 bp, Artificial Sequence
  Description of Artificial Sequence: Synthetic polynucleotide
gacatccagatgacccagtctccatcctctctgtctgcctctgtgggcgataccgctaccatcacctgtcaggccaacggctacctgaactggtatcagcagagaagaggcaaggcccctaagctgctgatctacgacggctccaaactggaaagaggcgtgccctctcggttctctggcagaagatggggccaagagtacaccctgaccatcaacaacctgcagcctgaggatatcgccacatacttttgccaggtgtacgagttcttcggccctggcaccagactggacctgaagagaacagtggccgctccttccgtgttcatcttcccaccatctgacgagcagctgaagtctggcaccgcttctgtcgtgtgcctgctgaacaacttctaccctcgggaagccaaggtgcagtggaaggtggacaatgccctgcagtccggcaactcccaagagtctgtgaccgagcaggactccaaggactctacctacagcctgtcctccacactgaccctgtctaaggccgactacgagaagcacaaggtgtacgcctgcgaagtgacccatcagggactgtctagccccgtgaccaagtccttcaacagaggcgagtgt

SEQ ID NO: 615 - DNA, 618 bp, Artificial Sequence
  Description of Artificial Sequence: Synthetic polynucleotide
gacatccagatgacacagagccctagcagcctgtctgccagcgtgggagataccgccacaattacctgtcaggccaacggctacctgaactggtatcagcagcggagaggcaaggcccctaagctgctgatctacgacggcagcaagctggaaagaggcgtgcccagcagattcagcggcagaagatggggccaagagtacaccctgaccatcaacaacctgcagcctgaggatattgccacatacttttgccaggtgtacgagttcttcggccctggcaccagactggacctgaagagaacagtggccgctcctagcgtgttcatcttcccaccttccgacgagcagctgaagtctggcacagcctctgtcgtgtgcctgctgaacaacttctaccccagagaagccaaggtgcagtggaaggtggacaacgccctgcagagcggcaatagccaagagagcgtgaccgagcaggacagcaaggactctacctactctctgagcagcaccctgacactgagcaaggccgactacgagaagcacaaagtgtacgcctgcgaagtgacccaccagggcctttctagccctgtgaccaagagcttcaaccggggcgagtgt

SEQ ID NO: 616 - DNA, 618 bp, Artificial Sequence
  Description of Artificial Sequence: Synthetic polynucleotide
gacatccagatgacccagtctccatcctctctgtctgcctctgtgggcgacagagctaccatcacctgtcaggccaacggctacctgaactggtatcagcagagaagaggcaaggcccctaagctgctgatctacgacggctccaaactggaaagaggcgtgccctccagattctccggctctagatggggccaagagtacaccctgaccatctctagcctgcagcctgaggatatcgccacatacttttgccaggtgtacgagttcttcggccctggcaccagactggacctgaagagaacagtggccgctccttccgtgttcatcttcccaccatctgacgagcagctgaagtctggcaccgcttctgtcgtgtgcctgctgaacaacttctaccctcgggaagccaaggtgcagtggaaggtggacaatgccctgcagtccggcaactcccaagagtctgtgaccgagcaggactccaaggactctacctacagcctgtcctccacactgaccctgtctaaggccgactacgagaagcacaaggtgtacgcctgcgaagtgacccatcagggactgtctagccccgtgaccaagtccttcaacagaggcgagtgt

SEQ ID NO: 617 - DNA, 618 bp, Artificial Sequence
  Description of Artificial Sequence: Synthetic polynucleotide
gacatccagatgacacagagccctagcagcctgtctgcctctgtgggcgatagagccacaatcacctgtcaggccaacggctacctgaactggtatcagcagagaagaggcaaggcccctaagctgctgatctacgacggcagcaaactggaaagaggcgtgccaagcagattcagcggctctagatggggccaagagtacaccctgaccatctctagcctgcagcctgaggatatcgccacatacttttgccaggtgtacgagttcttcggccctggcaccagactggacctgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 618 - DNA, 618 bp, Artificial Sequence
  Description of Artificial Sequence: Synthetic polynucleotide
gacatccagatgacccagtctccatcctctctgtctgccagagtgggcgataccgctaccatcacctgtcaggccaacggctacctgaactggtatcagcagagaagaggcaaggcccctaagctgctgatctacgacggctccaaactggaaagaggcgtgcccgctagattctccggcagaagatggggccaagagtacaccctgaccatcaacaacctgcagcctgaggacgtggccacatacttttgccaggtgtacgagttcatcgtgcccggcaccagactggacctgaagagaacagttgccgctccttccgtgttcatcttcccaccttccgacgagcagctgaagtctggcacagcttctgtcgtgtgcctgctgaacaacttctaccctcgggaagccaaggtgcagtggaaggtggacaatgccctgcagtccggcaactcccaagagtctgtgaccgagcaggactccaaggactctacctacagcctgtcctccacactgaccctgtctaaggccgactacgagaagcacaaggtgtacgcctgcgaagtgacccatcagggactgtctagccccgtgaccaagtccttcaacagaggcgagtgt

SEQ ID NO: 619 - DNA, 618 bp, Artificial Sequence
  Description of Artificial Sequence: Synthetic polynucleotide
gatattcagatgacacagagccccagtagcctgagcgcccgcgtgggcgacaccgcgaccatcacctgtcaggccaacggctatctgaactggtatcaacagaggaggggcaaggcccccaagctcctgatatacgacggcagcaagctggagaggggcgttcccgcacgcttcagcggcaggaggtggggccaggagtacacccttacaatcaacaacctgcagcccgaggacgtcgccacctatttctgccaagtttacgagttcatcgtgcccggcaccaggctggacctgaagcggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgc

SEQ ID NO: 620 - protein, 17 aa, Unknown
  Description of Unknown: signal peptide
KWVTFISLLFLFSSAYS

SEQ ID NO: 621 - protein, 24 aa, Unknown
  Description of Unknown: signal peptide
MDPKGSLSWRILLFLSLAFELSYG

SEQ ID NO: 622 - protein, 20 aa, Unknown
  Description of Unknown: signal peptide
MSVPTQVLGLLLLWLTDARC

SEQ ID NO: 623 - protein, 20 aa, Unknown
  Description of Unknown: signal peptide
METDTLLLWVLLLWVPGSTG

SEQ ID NO: 624 - protein, 18 aa, Unknown
  Description of Unknown: signal peptide
MKWVTFISLLFLFSSAYS

SEQ ID NO: 625 - protein, 20 aa, Unknown
  Description of Unknown: signal peptide
MRCLAEFLGLLVLWIPGAIG

SEQ ID NO: 626 - protein, 24 aa, Unknown
  Description of Unknown: signal peptide
MDPKGSLSWRILLFLSLAFELSYG

SEQ ID NO: 627 - protein, 4 aa, Artificial Sequence
  Description of Artificial Sequence: Synthetic peptide
FDFD

SEQ ID NO: 628 - protein, 36 aa, Artificial Sequence
  Description of Artificial Sequence: Synthetic polypeptide
RVSLTRHASWDFDTFSFYMDLKALRSDDTAVYFCAR

SEQ ID NO: 629 - protein, 36 aa, Artificial Sequence
  Description of Artificial Sequence: Synthetic polypeptide
RVSLTRHASFDFDTFSFYMDLKALRSDDTAVYFCAR

SEQ ID NO: 630 - protein, 34 aa, Artificial Sequence
  Description of Artificial Sequence: Synthetic polypeptide
TGQPNNPRQFQGRVSLTRHASWDFDTFSFYMDLK

SEQ ID NO: 631 - protein, 38 aa, Artificial Sequence
  Description of Artificial Sequence: Synthetic polypeptide
DIQMTQSPSSLSASVGDTVTITCQANGYLNWYQQRRGK

SEQ ID NO: 632 - protein, 453 aa, Artificial Sequence
  Description of Artificial Sequence: Synthetic polypeptide
EVQLVESGGGLVKAGGSLILSCGVSNFRISAHTMNWVRRVPGGGLEWVASISTSSTYRDYADAVKGRFTVSRDDLEDFVYLQMHKMRVEDTAIYYCARKGSDRLSDNDPFDAWGPGTVVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 633 - protein, 462 aa, Artificial Sequence
  Description of Artificial Sequence: Synthetic polypeptide
EVQLVQSGTQMKEPGASVTISCVTSGYEFVEILINWVRQVPGRGLEWMGWMNPRGGGVNYARQFQGKVTMTRDVYRDTAYLTLSGLTSGDTAKYFCVRGRSCCGGRRHCNGADCFNWDFQHWGQGTLVIVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 634 - protein, 462 aa, Artificial Sequence
  Description of Artificial Sequence: Synthetic polypeptide
EVQLVQSGTQMKEPGASVTISCVTSGYEFVEILINWVRQVPGRGLEWMGWMNPRGGGVNYARQFQGKVTMTRDVYRDTAYLTLSGLTSGDTAKYFCVRGKSCCAGRRFCGPTDCYNWDFAHWGQGTLVIVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 635 - protein, 455 aa, Artificial Sequence
  Description of Artificial Sequence: Synthetic polypeptide
QVRLSQSGGQMKKPGDSMRISCRASGYEFINCPINWIRLAPGKRPEWMGWMKPRGGAVSYARQLQGRVTMTRDMYSETAFLELRSLTSDDTAVYFCTRGKYCTARDYYNWDFEHWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 636 - protein, 465 aa, Artificial Sequence
  Description of Artificial Sequence: Synthetic polypeptide
RVQLVESGGGVVQPGKSVRLSCVVSDFPFSKYPMYWVRQAPGKGLEWVAAISGDAWHVVYSNSVQGRFLVSRDNVKNTLYLEMNSLKIEDTAVYRCARMFQESGPPRLDRWSGRNYYYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 637 - protein, 467 aa, Artificial Sequence
  Description of Artificial Sequence: Synthetic polypeptide
QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 638 - protein, 470 aa, Artificial Sequence
  Description of Artificial Sequence: Synthetic polypeptide
QVQLVQSGAEVKKPGSSVKVSCKASGNSFSNHDVHWVRQATGQGLEWMGWMSHEGDKTGLAQKFQGRVTITRDSGASTVYMELRGLTADDTAIYYCLTGSKHRLRDYFLYNEYGPNYEEWGDYLATLDVWGHGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 639 - protein, 451 aa, Artificial Sequence
  Description of Artificial Sequence: Synthetic polypeptide
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 640 - protein, 451 aa, Artificial Sequence; identical to SEQ ID NO: 639
  Description of Artificial Sequence: Synthetic polypeptide

SEQ ID NO: 641 - protein, 453 aa, Artificial Sequence
  Description of Artificial Sequence: Synthetic polypeptide
EVQLVESGGGLVKAGGSLILSCGVSNFRISAHTMNWVRRVPGGGLEWVASISTSSTYRDYADAVKGRFTVSRDDLEDFVYLQMHKMRVEDTAIYYCARKGSDRLSDNDPFDAWGPGTVVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLLPPKPKDTLMISRTPEVTCVVVDVSHEDPEVKFNWYVDGVEVHNAKTKPPEEQYNSTLRVVSILTVLHQDWLNGKEYKCKVSNKALPAPIEKTISKAKGQPREPQVYTLPPSREEMTKNQVSLTCLVKGFYPSDIAVEWESNGQPENNYKTTPLVLDSDGSFFLYSKLTVDKSRWQQGNVFSCSVLHEALHSHYTQKSLSLSPGK

SEQ ID NO: 642 - protein, 453 aa, Artificial Sequence
  Description of Artificial Sequence: Synthetic polypeptide
EVQLVESGGGLVKAGGSLILSCGVSNFRISAHTMNWVRRVPGGGLEWVASISTSSTYRDYADAVKGRFTVSRDDLEDFVYLQMHKMRVEDTAIYYCARKGSDRLSDNDPFDAWGPGTVVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELVGGPSVFLLPPKPKDTLMISRTPEVTCVVVDVSHEDPEVKFNWYVDGVEVHNAKTKPPEEQYNSTLRVVSVLTVLHQDWLNGKEYKCKVSNKALPAPIEKTISKAKGQPREPQVYTLPPSREEMTKNQVSLTCLVKGFYPSDIAVEWESNGQPENNYKTTPLVLDSDGSFFLYSKLTVDKSRWQQGNVFSCSVLHEALHSHYTQKSLSLSPGK

SEQ ID NO: 643 - protein, 214 aa, Artificial Sequence
  Description of Artificial Sequence: Synthetic polypeptide
DVVMTQSPSTLSASVGDTITITCRASQSIETWLAWYQQKPGKAPKLLIYKASTLKTGVPSRFSGSGSGTEFTLTISGLQFDDFATYHCQHYAGYSATFGQGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 644 - protein, 211 aa, Artificial Sequence
  Description of Artificial Sequence: Synthetic polypeptide
YIGVTQSPAILSVSLGERVTLSCKTSQAITPRHLVWHRQKGGQAPSLVMTGTSERASGIPDRFIGSGSGTDFTLTITRLEAEDFAVYYCQCLEAFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 645 - protein, 210 aa, Artificial Sequence; identical to SEQ ID NO: 48
  Description of Artificial Sequence: Synthetic polypeptide

SEQ ID NO: 646 - protein, 210 aa, Artificial Sequence; identical to SEQ ID NO: 48
  Description of Artificial Sequence: Synthetic polypeptide

SEQ ID NO: 647 - protein, 219 aa, Artificial Sequence
  Description of Artificial Sequence: Synthetic polypeptide
DIVMTQTPLSLSVTPGQPASISCKSSESLRQSNGKTSLYWYRQKPGQSPQLLVFEVSNRFSGVSDRFVGSGSGTDFTLRISRVEAEDVGFYYCMQSKDFPLTFGGGTKVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 648 - protein, 216 aa, Artificial Sequence
  Description of Artificial Sequence: Synthetic polypeptide
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 649 - protein, 219 aa, Artificial Sequence
  Description of Artificial Sequence: Synthetic polypeptide
EVVITQSPLFLPVTPGEAASLSCKCSHSLQHSTGANYLAWYLQRPGQTPRLLIHLATHRASGVPDRFSGSGSGTDFTLKISRVESDDVGTYYCMQGLHSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 650 - protein, 210 aa, Artificial Sequence; identical to SEQ ID NO: 48
  Description of Artificial Sequence: Synthetic polypeptide

SEQ ID NO: 651 - protein, 210 aa, Artificial Sequence; identical to SEQ ID NO: 48
  Description of Artificial Sequence: Synthetic polypeptide

SEQ ID NO: 652 - protein, 214 aa, Artificial Sequence; identical to SEQ ID NO: 643
  Description of Artificial Sequence: Synthetic polypeptide

SEQ ID NO: 653 - protein, 214 aa, Artificial Sequence; identical to SEQ ID NO: 643
  Description of Artificial Sequence: Synthetic polypeptide

The invention claimed is:

1. An antibody or an antigen-binding fragment thereof that binds to human immunodeficiency virus-1 (HIV-1) Envelope glycoprotein gp120, the antibody or antigen-binding fragment thereof comprising (i) a heavy chain variable region (VH) comprising VH complementary determining regions 1-3 (CDRs 1-3) and (ii) a light chain variable region (VL) comprising VL CDRs 1-3, wherein the VH CDRs 1-3 and VL CDRs 1-3 have the sequences set forth in:
   (i) SEQ ID NOs.: 159, 138, 139, 140, 141, and 142, respectively;
   (ii) SEQ ID NOs.: 137, 160, 139, 140, 141, and 142, respectively;
   (iii) SEQ ID NOs.: 137, 161, 139, 140, 141, and 142, respectively;
   (iv) SEQ ID NOs.: 137, 162, 139, 140, 141, and 142, respectively;
   (v) SEQ ID NOs.: 137, 163, 139, 140, 141, and 142, respectively;
   (vi) SEQ ID NOs.: 137, 138, 164, 140, 141, and 142, respectively;
   (vii) SEQ ID NOs.: 159, 138, 164, 140, 141, and 142, respectively;
   (viii) SEQ ID NOs.: 137, 138, 139, 140, 165, and 142, respectively;
   (ix) SEQ ID NOs.: 137, 138, 139, 140, 166, and 142, respectively;
   (x) SEQ ID NOs.: 137, 138, 139, 140, 167, and 142, respectively;
   (xi) SEQ ID NOs.: 137, 138, 139, 140, 168, and 142, respectively;
   (xii) SEQ ID NOs.: 137, 138, 154, 140, 141, and 142, respectively; or
   (xiii) SEQ ID NOs.: 137, 138, 139, 140, 141, and 142, respectively; and wherein the antibody or antigen-binding fragment thereof includes in framework region 3 (FR3) of the VH at position corresponding to 74a, 74b, 74c, and 74d (Kabat numbering) the amino acid sequence set forth in SEQ ID NO: 627.

2. The antibody or antigen-binding fragment thereof of claim 1, wherein the VH comprises one or more of the following amino acids at the indicated positions (position numbering according to Kabat): valine at position 5, glutamic acid at position 10, lysine at position 12, lysine at position 23, asparagine at position 28, arginine at position 30, tyrosine at position 32, threonine at position 68, methionine at position 69, histidine at position 72, phenylalanine at position 76, alanine at position 78, serine at position 82a, arginine at position 82b, threonine at position 89, tyrosine at position 99, glutamine at position 105, or methionine at position 108.

3. The antibody or antigen-binding fragment thereof of claim 1, wherein the FR3 of the VH comprises the following amino acid sequence: RVSLTRHASFDFDTFSFYMDLKALRSDDTAVYFCAR (SEQ ID NO: 629).

4. The antibody or antigen-binding fragment thereof of claim 1, wherein the VL comprises one or more of the following amino acids at the indicated positions (position numbering according to Kabat): arginine at position 18, alanine at position 19, serine at position 65, threonine or histidine at position 72, lysine at position 74, serine at position 76, serine at position 77, phenylalanine at position 98, or glycine at position 99.

5. The antibody or antigen-binding fragment thereof of claim 1, comprising a human IgG1 Fc region.

6. The antibody or antigen-binding fragment thereof of claim 5, wherein the human IgG1 Fc region is IgG1m17 (SEQ ID NO: 348).

7. The antibody or antigen-binding fragment thereof of claim 1, comprising a human IgG1 Fc region comprising (position numbered according to EU numbering):
   (i) aspartic acid at position 239, glutamic acid at position 332, alanine at position 236, leucine at position 330;
   (ii) aspartic acid at position 239, glutamic acid at position 332, leucine at position 428, and serine at position 434;
   (iii) aspartic acid at position 239, glutamic acid at position 332, alanine at position 236, leucine at position 428, and serine at position 434;
   (iv) aspartic acid at position 239, glutamic acid at position 332, leucine at position 330, leucine at position 428, and serine at position 434;
   (v) aspartic acid at position 239, glutamic acid at position 332, alanine at position 236, leucine at position 330, leucine at position 428, and serine at position 434; or
   (vi) leucine at position 243, proline at position 292, leucine at position 300, isoleucine at position 305, leucine at position 396, leucine at position 428, and serine at position 434.

8. The antibody or antigen-binding fragment thereof of claim 1, comprising a human kappa light chain constant region.

9. The antibody or antigen-binding fragment thereof of claim 8, wherein the human kappa light chain constant region is Km3 (SEQ ID NO:351).

10. The antibody or antigen-binding fragment thereof of claim 1, wherein the antibody or antigen-binding fragment has a serum half-life in a human of at least about 3 days.

11. The antibody of claim 1, the antibody comprising (i) a heavy chain variable region (VH) comprising VH complementary determining regions 1-3 (CDRs 1-3) and (ii) a light chain variable region (VL) comprising VL CDRs 1-3, wherein the VH CDRs 1-3 and VL CDRs 1-3 have the sequences set forth in:
   (i) SEQ ID NOs.: 137, 138, 139, 140, 141, and 142, respectively; or (ii) SEQ ID NOs.: 153, 138, 154, 140, 141, and 142, respectively,
wherein the antibody comprises a human IgG1 Fc region comprising (position numbered according to EU numbering):
  (i) aspartic acid at position 239, glutamic acid at position 332, alanine at position 236, leucine at position 330;
  (ii) aspartic acid at position 239, glutamic acid at position 332, leucine at position 428, and serine at position 434;
  (iii) aspartic acid at position 239, glutamic acid at position 332, alanine at position 236, leucine at position 428, and serine at position 434;
  (iv) aspartic acid at position 239, glutamic acid at position 332, leucine at position 330, leucine at position 428, and serine at position 434;
  (v) aspartic acid at position 239, glutamic acid at position 332, alanine at position 236, leucine at position 330, leucine at position 428, and serine at position 434; or
  (vi) leucine at position 243, proline at position 292, leucine at position 300, isoleucine at position 305, leucine at position 396, leucine at position 428, and serine at position 434, and wherein the antibody comprises in framework region 3 (FR3) of the VH at positions corresponding to 74a, 74b, 74c, and 74d (Kabat numbering) the amino acid sequence set forth in SEQ ID NO: 627.

12. The antibody of claim 11, wherein the antibody comprises a light chain comprising an alanine at position 19 (Kabat numbering).

13. The antibody of claim 11, wherein the FR3 of the VH comprises the following amino acid sequence: RVSLTRHASFDFDTFSFYMDLKALRSDDTAVYFCAR (SEQ ID NO: 629).

14. The antibody of claim 11, wherein the human IgG1 Fc region is IgG1m17 (SEQ ID NO:348).

15. The antibody of claim 11, wherein the antibody comprises a human kappa light chain constant region.

16. The antibody of claim 15, wherein the human kappa light chain constant region is Km3 (SEQ ID NO:351).

17. The antibody or antigen-binding fragment thereof of claim 11, wherein the antibody or antigen-binding fragment has a serum half-life in a human of at least about 3 days.

18. The antibody or an antigen-binding fragment thereof of claim 1, the antibody or antigen-binding fragment thereof comprising a heavy chain variable region (VH) and a light chain variable region (VL), wherein the VH and VL comprise the amino acid sequences set forth, respectively, below:
  (i) SEQ ID NOs.: 477 and 223;
  (ii) SEQ ID NOs.: 477 and 278;
  (iii) SEQ ID NOs.: 477 and 292; or
  (iv) SEQ ID NOs.: 478 and 276.

19. The antibody or antigen-binding fragment of claim 18, wherein the VH and VL comprise the amino acid sequences set forth in SEQ ID NOs.: 477 and 278, respectively.

20. The antibody or antigen-binding fragment thereof of claim 1, comprising a VH that is at least 80%, at least 85%, at least 90%, at least 91%, at least 92%, at least 93%, at least 94%, at least 95%, at least 96%, at least 97%, at least 98%, at least 99%, or 100%, identical to an amino acid sequence selected from the group consisting of SEQ ID NOs: 477-478 and a VL that is at least 80%, at least 85%, at least 90%, at least 91%, at least 92%, at least 93%, at least 94%, at least 95%, at least 96%, at least 97%, at least 98%, at least 99%, or 100%, identical to an amino acid sequence selected from the group consisting of SEQ ID NOs: 222-311, 479-516 and 569.

21. The antibody or antigen-binding fragment thereof of claim 18, comprising a human IgG1 Fc region.

22. The antibody or antigen-binding fragment thereof of claim 21, wherein the human IgG1 Fc region is IgG1m17 (SEQ ID NO:348).

23. The antibody or antigen-binding fragment thereof of claim 18, comprising a human IgG1 Fc region comprising (position numbered according to EU numbering):
  (i) aspartic acid at position 239, glutamic acid at position 332, alanine at position 236, leucine at position 330;
  (ii) aspartic acid at position 239, glutamic acid at position 332, leucine at position 428, and serine at position 434;
  (iii) aspartic acid at position 239, glutamic acid at position 332, alanine at position 236, leucine at position 428, and serine at position 434;
  (iv) aspartic acid at position 239, glutamic acid at position 332, leucine at position 330, leucine at position 428, and serine at position 434;
  (v) aspartic acid at position 239, glutamic acid at position 332, alanine at position 236, leucine at position 330, leucine at position 428, and serine at position 434; or
  (vi) leucine at position 243, proline at position 292, leucine at position 300, isoleucine at position 305, leucine at position 396, leucine at position 428, and serine at position 434.

24. The antibody or antigen-binding fragment thereof of claim 18, wherein the antibody comprises a human kappa light chain constant region.

25. The antibody or antigen-binding fragment thereof of claim 24, wherein the human kappa light chain constant region is Km3 (SEQ ID NO:351).

26. The antibody or antigen-binding fragment thereof of claim 18, wherein the antibody or antigen-binding fragment has a serum half-life in a human of at least about 3 days.

27. An antigen-binding fragment of claim 1, comprising a scFv, sc(Fv)$_2$, Fab, F(ab)$_2$, Fab', F(ab')$_2$, Facb or Fv fragment.

28. The antibody of claim 1, the antibody comprising a heavy chain and a light chain, wherein the heavy chain and the light chain comprise the amino acid sequences set forth, respectively, below:
  (i) SEQ ID NOs.: 529 and 49;
  (ii) SEQ ID NOs.: 529 and 103;
  (iii) SEQ ID NOs.: 529 and 117; or
  (iv) SEQ ID NOs.: 530 and 101.

29. The antibody of claim 28, wherein the heavy chain and light have the amino acid sequences set forth in SEQ ID NOs.: 529 and 103, respectively.

30. The antibody or antigen-binding fragment thereof of claim 1, comprising a heavy chain (HC) that is at least 80%, at least 85%, at least 90%, at least 91%, at least 92%, at least 93%, at least 94%, at least 95%, at least 96%, at least 97%, at least 98%, at least 99%, or 100%, identical to an amino acid sequence selected from the group consisting of SEQ ID NOs: 529-530 and a light chain (LC) that is at least 80%, at least 85%, at least 90%, at least 91%, at least 92%, at least 93%, at least 94%, at least 95%, at least 96%, at least 97%, at least 98%, at least 99%, or 100%, identical to an amino acid sequence selected from the group consisting of SEQ ID NOs: 48-136 and 531-567.

31. The antibody or antigen-binding fragment thereof of claim 1, wherein at least 50%, at least 60%, at least 70%, least 80%, at least 85%, at least 90%, or more, N-linked glycosylation sites in the VL are sialylated.

32. The antibody or antigen-binding fragment of claim 1, wherein the asparagine at VL amino acid position 72 according to Kabat numbering (N72) is sialylated.

33. The antibody or antigen-binding fragment of claim 31, wherein the sialylated N-linked glycosylation sites in the VL comprise from 1 to 5 sialic acid residues.

34. The antibody or antigen-binding fragment thereof of claim 31, wherein the VL are sialylated with N-acetyl-neuraminic acid (NANA).

35. The antibody or antigen-binding fragment thereof of claim 33, wherein the sialic acid residues are present in biantennary structures.

36. The antibody or antigen-binding fragment thereof of claim 33, wherein the sialic acid residues are present in complex N-linked glycan structures.

37. The antibody or antigen-binding fragment thereof of claim 33, wherein the sialic acid residues are present in hybrid N-linked glycan structures.

38. The antibody or antigen-binding fragment thereof of claim 36, wherein the N-linked glycan structures are terminally sialylated.

39. A bispecific antibody comprising:
a first antigen binding arm that binds to gp120, the first antigen binding arm comprising: the VH and the VL of claim 18; and a second antigen binding arm binding to a second antigen.

40. A pharmaceutical composition comprising the antibody or antigen-binding fragment of claim 1, and a pharmaceutically acceptable carrier.

41. The pharmaceutical composition of claim 40, further comprising a second agent for treating an HIV infection.

42. The pharmaceutical composition of claim 41, further comprising a second antibody or antigen-binding fragment thereof that binds, inhibits, and/or neutralizes HIV, wherein the second antibody or antigen-binding fragment thereof does not compete with the antibody or antigen-binding fragment of claim 1 for binding to gp120.

43. A chimeric antigen receptor (CAR) comprising an antigen-binding fragment according to claim 27.

44. A CAR T-cell comprising the CAR of claim 43.

* * * * *